United States Patent 8,586,006 (ORGAN-SPECIFIC PROTEINS AND METHODS OF THEIR USE) - sequence listing, part 3

SEQ ID NO: 2942 - DNA, 2100 bp, Homo sapiens
ccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttaccctcaggcaaagttgtatccaggaaaatcattgttgagaagattgctcacgtctggcatcgtgattcaggtgtttccactgcatgacagtgaagccctgaagaagcttgaggacacctggtacactcggtttgctttgaagtatcagcccatagagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaatgatgagtgttatatctgtggtcactaactgtgcgctgattggaatgtcaccacaagtgaatgcagcctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcactcccaaccccaccatggcccagggacccgtggacaggttggggatggggtgtgtgcccactgtgctcatcacaggagcctcagttgagagtgagcggggtacagtaaggcagtgcttcccacactggacctctttcctggttctcttttgcaatacattaacagaccctttatcaacataaacaatagtaactgagctattaaaggcaaaaaaaaaaaaaaaaaaaaaaaaaaaaaaaaaaaaaaaaaaaaaaaaaaaaaaaaaaaaaa

SEQ ID NO: 2943 - DNA, 6147 bp, Homo sapiens
gcgggcgccggcaatcgagtggcttcctggccatggagaggagatctggacccgaggacgccagggactcctctccgtctccctggaccgctgtgtaggcacctgagttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccatggggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaacatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttccaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgttttttttttttttgtatattgatgaatgagatcttacctattaaatatattattggaaaaaaaaaaaaaaaaaaaattaaagtttgagtgtgtgtgtgtgtgtgtgtgtgtgtgtgtgtgtgtgtgttttatgacttaaatatctttacgtgtgttttttagagcttggttctttaaagatttggagaagatatgtaaattaccaaggcacttggtttttctgttttatatactaataatcagggcctaagttaaataaaaatatgtgtgcatgtatttt

SEQ ID NO: 2944 - DNA, 2039 bp, Homo sapiens
cctttgtcattctagctgcctgctgcctccgcagcgtccccccagctctccctgtgctaactgcctgcaccttggacagagcgggtgcgcaaatcagaaggattagttgggacctgccttggcgaccccatggcatcccccagaaccgtaactattgtggccctctcagtggccctgggactcttctttgttttcatggggactatcaagctgacccccaggctcagcaaggatgcctacagtgagatgaaacgtgcttacaagagctatgttcgagccctccctctgctgaagaaaatggggatcaattccattctcctccgaaaaagcattggtgcccttgaagtggcctgtggcatcgtcatgacccttgtgcctgggcgtcccaaagatgtggccaacttcttcctactgttgctggtgttggctgtgctcttcttccaccagctggtcggtgatcctctcaaacgctacgcccatgctctggtgtttggaatcctgctcacttgccgcctgctgattgctcgcaagcccgaagaccggtcttctgagaagaagcctttgccagggaatgctgaggagcaaccctccttatatgagaaggcccctcagggcaaagtgaaggtgtcatagaaaagtggaagtgcaaagagtggaccttccaggcagttgcgtccatgacaccaggaagatgtcagtgtgtgtttttcatttgatttatttatcttggggaaagtgaaaaatgtaatctgcaagttaatgaccctattggcttgtgtacatctatatgctaaaatgacttccccacattgacatttgtgcgccacctttaatcactctggggcaactctcacatcttgctgcatgtacatgtatacggctactattgaagtgtaattgtgagatggactccaacaagcatgtgactgtgagattgtgtgtgggaaaatgtatttaactactctgtgtgtgtgtgtgtgtgtgtgtgcgcacgcgcgcacgcgcacacactcacgcacacacaagcagagaaggcgctgatcttgaactaatcctgcacaggcatccttccctttatagattgattccagcaaaggcggaataaaacaaatttcctatgaagagaatcctgatatgaaacaagtcatgtagtctcatggccgggaatctctccacagatactaacaacttaaacttactactttaggagaaaaaaaaaaacattcaatttcggacactgagttatatatgaaattaattaggctctagtccaacagttgtttacattttaaatagtccatattgaatttaattaaaacaagggatgcatgcagtcaaattgatagtttaattcttcaagtgataatataggaagtttcaccttgcctttgtccaagccccacctattaaaaccctttactcacagtttgaaactgaagcagtaaacttgtttccagacatctttttcagattgtcttaagcccaaagttgcctcacttccactattctcagcagccaaccaggatttggcagctgctccactgttacggttgagggaacagggatcagccctgttagaagtctgtgagcctcaaactctacctgttctctgcaatcatccaaaatttgaaaaagaagctatatccagtgtttcactgccaaacagattcactactcttactgattcttcactgagctttgctagtataagcagagttccaagtctcccctagggttgtctctacatttctttatcattccagtgggtagggtttagctgggggaaggacatttcataagggttagttggactgagcagtatggacatttgcttttttcattacgtactgttgtttttccttgttaggtgtgctttggtggttttaatattattgtgccagggatggggaaatggggggggttgtgtgggaagagtacttattattgtgttttcttcagtgtaattgttcttggtaattgatacctctctgttttatttctctcattctttcaaaataaaactttttgaaatttggagg

SEQ ID NO: 2945 - DNA, 3254 bp, Homo sapiens
ggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaataaatttctaaattataaaaaaaaaaaaaaaaaa

SEQ ID NO: 2946 - DNA, 6189 bp, Homo sapiens
cgcgccgcctcgctagccgaaacctgcccagccggtgcccggccactgcgcacgcgcgggacgacgtcacgtgcgctcccggggctggacggagctggcaggaggggccttgccagcttccgccgccgcgtcgtttcaggacccggacggcggattcgcgctgcctccgccgccgcggggcagccggggggcagggagcccagcgaggggcgcgcgtgggcgcggccatgggactgcgccggatccggtgacagcagggagccaagcggcccgggccctgagcgcgtcttctccggggggcctcgccctcctgctcgcggggccggggctcctgctccggttgctggcgctgttgctggctgtggcggcggccaggatcatgtcgggtcgccgctgcgccggcgggggagcggcctgcgcgagcgccgcggccgaggccgtggagccggccgcccgagagctgttcgaggcgtgccgcaacggggacgtggaacgagtcaagaggctggtgacgcctgagaaggtgaacagccgcgacacggcgggcaggaaatccaccccgctgcacttcgccgcaggttttgggcggaaagacgtagttgaatatttgcttcagaatggtgcaaatgtccaagcacgtgatgatgggggccttattcctcttcataatgcatgctcttttggtcatgctgaagtagtcaatctccttttgcgacatggtgcagaccccaatgctcgagataattggaattatactcctctccatgaagctgcaattaaaggaaagattgatgtttgcattgtgctgttacagcatggagctgagccaaccatccgaaatacagatggaaggacagcattggatttagcagatccatctgccaaagcagtgcttactggtgaatataagaaagatgaactcttagaaagtgccaggagtggcaatgaagaaaaaatgatggctctactcacaccattaaatgtcaactgccacgcaagtgatggcagaaagtcaactccattacatttggcagcaggatataacagagtaaagattgtacagctgttactgcaacatggagctgatgtccatgctaaagataaaggtgatctggtaccattacacaatgcctgttcttatggtcattatgaagtaactgaacttttggtcaagcatggtgcctgtgtaaatgcaatggacttgtggcaattcactcctcttcatgaggcagcttctaagaacagggttgaagtatgttctcttctcttaagttatggtgcagacccaacactgctcaattgtcacaataaaagtgctatagacttggctcccacaccacagttaaaagaaagattagcatatgaatttaaaggccactcgttgctgcaagctgcacgagaagctgatgttactcgaatcaaaaaacatctctctctggaaatggtgaatttcaagcatcctcaaacacatgaaacagcattgcattgtgctgctgcatctccatatcccaaaagaaagcaaatatgtgaactgttgctaagaaaaggagcaaacatcaatgaaaagactaaagaattcttgactcctctgcacgtggcatctgagaaagctcataatgatgttgttgaagtagtggtgaaacatgaagcaaaggttaatgctctggataatcttggtcagacttctctacacagagctgcatattgtggtcatctacaaacctgccgcctactcctgagctatgggtgtgatcctaacattatatcccttcagggctttactgctttacagatgggaaatgaaaatgtacagcaactcctccaagagggtatctcattaggtaattcagaggcagacagacaattgctggaagctgcaaaggctggagatgtcgaaactgtaaaaaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaaggaggccttgtacctttgcacaatgcatgttcttatggacattatgaagttgcagaacttcttgttaaacatggagcagtagttaatgtagctgatttatggaaatttacacctttacatgaagcagcagcaaaaggaaaatatgaaatttgcaaacttctgctccagcatggtgcagaccctacaaaaaaaaacagggatggaaatactcctttggatcttgttaaagatggagatacagatattcaagatctgcttaggggagatgcagctttgctagatgctgccaagaagggttgtttagccagagtgaagaagttgtcttctcctgataatgtaaattgccgcgatacccaaggcagacattcaacacctttacatttagcagctggttataataatttagaagttgcagagtatttgttacaacacggagctgatgtgaatgcccaagacaaaggaggacttattcctttacataatgcagcatcttacgggcatgtagatgtagcagctctactaataaagtataatgcatgtgtcaatgccacggacaaatgggctttcacacctttgcacgaagcagcccaaaagggacgaacacagctttgtgctttgttgctagcccatggagctgacccgactcttaaaaatcaggaaggacaaacacctttagatttagtttcagcagatgatgtcagcgctcttctgacagcagccatgcccccatctgctctgccctcttgttacaagcctcaagtgctcaatggtgtgagaagcccaggagccactgcagatgctctctcttcaggtccatctagcccatcaagcctttctgcagccagcagtcttgacaacttatctgggagtttttcagaactgtcttcagtagttagttcaagtggaacagagggtgcttccagtttggagaaaaaggaggttccaggagtagattttagcataactcaattcgtaaggaatcttggacttgagcacctaatggatatatttgagagagaacagatcactttggatgtattagttgagatggggcacaaggagctgaaggagattggaatcaatgcttatggacataggcacaaactaattaaaggagtcgagagacttatctccggacaacaaggtcttaacccatatttaactttgaacacctctggtagtggaacaattcttatagatctgtctcctgatgataaagagtttcagtctgtggaggaagagatgcaaagtacagttcgagagcacagagatggaggtcatgcaggtggaatcttcaacagatacaatattctcaagattcagaaggtttgtaacaagaaactatgggaaagatacactcaccggagaaaagaagtttctgaagaaaaccacaaccatgccaatgaacgaatgctatttcatgggtctccttttgtgaatgcaattatccacaaaggctttgatgaaaggcatgcgtacataggtggtatgtttggagctggcatttattttgctgaaaactcttccaaaagcaatcaatatgtatatggaattggaggaggtactgggtgtccagttcacaaagacagatcttgttacatttgccacaggcagctgctcttttgccgggtaaccttgggaaagtctttcctgcagttcagtgcaatgaaaatggcacattctcctccaggtcatcactcagtcactggtaggcccagtgtaaatggcctagcattagctgaatatgttatttacagaggagaacaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgcagcggtttacaaaattttttcatatgtattgttcatctatacttcatcttacatcgtcatgattgagtgatctttacatttgattccagaggctatgttcagttgttagttgggaaagattgagttatcagatttaatttgccgatgggagcctttatctgtcattagaaatctttctcatttaagaacttatgaatatgctgaagatttaatttgtgatacctttgtatgtatgagacacattccaaagagctctaactatgataggtcctgattactaaagaagcttctttactggcctcaatttctagctttcatgttggaaaattttctgcagtccttctgtgaaaattagagcaaagtgctcctgttttttagagaaactaaatcttgctgttgaacaattattgtgttcttttcatggaacataagtaggatgttaacatttccagggtgggaagggtaatcctaaatcatttcccaatctattctaattaccttaaatctaaaggggaaaaaaaaaatcacaaacaggactgggtagttttttatcctaagtatattttttcctgttctttttacttggttttattgctgtatttatagccaatctatacatcatgggtaaacttaacccagaactataaaatgtagttgtttcagtccccttcaggcctcctgaatgggcaagtgcagtgaaacaggtgcttcctgctcctgggttttctctccatgatgttatgcccaattggaaatatgctgtcagtttgtgcaccatatggtgaccacgcctgtgctcagtttggcagctatagaaggaaatgctgtcccataaaatgccatccctatttctaatataacactcttttccaggaagcatgcttaagcatcttgttacagagacatacatccattatggcttggcaatctcttttatttgttgactctagctcccttcaaagtcgaggaaagatctttactcacttaatgaggacattccccatcactgtctgtaccagttcacctttattttacgttttattcagtctgtaaattaactggccctttgcagtaacttgtacataaagtgctagaaaatcatgttccttgtcctgagtaagagttaatcagagtaagtgcatttctggagttgtttctgtgatgtaaattatgatcattatttaagaagtcaaatcctgatcttgaagtgctttttatacagctctctaataattacaaatatccgaaagtcatttcttggaacacaagtggagtatgccaaattttatatgaatttttcagattatctaagcttccaggttttataattagaagataatgagagaattaatggggtttatatttacattatctctcaactatgtagcccatattactcaccctatgagtgaatctggaattgcttttcatgtgaaatcattgtggtctatgagtttacaatactgcaaactgtgttattttatctaaaccattgcttaatgagtgtgtttttccatgaatgaatataccgtggttcatatgttagcatggcagcattttcagatagctttttgtttgttgggaagttggggttttggggggagggggagtattagtacgttgcatggaatagcctactttataatgatgggaatgctttttcttttgttttgggatttttttttttgaagtgaaatttaactttttgtgccagtagtactattatacccatcttcagtgtcttacttgtactgtatcaaattccataccctcatttaattcttaataaaactgttcacttgtaaaaaaaaaaaaaaaaaaaaaaaaaaaaaaaaa

SEQ ID NO: 2947 - DNA, 1409 bp, Homo sapiens
gctgcccgaaggacctgttgtgccgggtccggaaagcgtgtttcgctccctttcccttgagggagtggggagggaatgtgactcttttcgcccagcgccgtggactcgcggcttgtggctcccaagttagggagtgagaggatcgcccgccgagggggtggctccgcagcccggctgcgcgagacgcttcccgctcggggacccgccttccgaggccaggtgaacgttaccggccccctgacctccagcagatccacacgtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgacaaaaaaaaaaaaaaaaaa

SEQ ID NO: 2948 - DNA, 1327 bp, Homo sapiens
ttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgacaaaaaaaaaaaaaaaaaa

SEQ ID NO: 2949 - DNA, 1288 bp, Homo sapiens
ttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgacaaaaaaaaaaaaaaaaaa

SEQ ID NO: 2950 - DNA, 1388 bp, Homo sapiens
ttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgacaaaaaaaaaaaaaaaaaa

SEQ ID NO: 2951 - DNA, 4571 bp, Homo sapiens
agagatcttgcagccgcgagcgaagactgccctatcctcagactctaccgaaccccctgtggcctgcggagacgaggagacggacgggtctggtggccaatgagagcttcgatctcttgccccccgcccaatgggccgctgctcatgggccggggcgggactaggagggcaggtaggggcggtccgggctggcgcgcggcgcggcggctacgcggctgcggctcacagagctagcgcctctctgggtgtccgtgccagtgctgcgcgggaaggcaccaccaccacagccgccgccgctggccagggtgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagcttcctctccagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgaggtggcctggtttgctttcgaccctggctcggcgcactcggacatcatcctctccaatgacaacctgacagtgacctgtagtagctatgatgaccgggtggtgctagggaagactggcttctccaagggcatccactactgggagctcacggtagatcgctatgacaaccaccctgatcctgcctttggtgtggctcgcatggacgtgatgaaggatgtgatgttaggaaaagacgacaaagcttgggcaatgtatgtggacaataaccggagctggttcatgcacaacaactcgcacaccaacagaactgagggagggatcacaaaaggggccacaattggggtcctcctcgacttcaatagaaaaaacttgacattttttatcaacgatgaacaacaaggtcccatagcatttgataacgtggagggcctcttcttccctgcggtcagcctgaacaggaacgtgcaggtcacgctgcacaccgggctcccagtccccgacttctactccagcagagcatcaatagcctaaggatgtgccgtggaggcgccagctgcctgttcttacctccgcctgcgagagccacagcaaggagctcagccagccgtggtggggtgcagagttggcaggagtgggagaaggaggagagaaaagctggtcctctgcagtctttacacccacagctctgcccttttccctttcaacctctcctccgctgtcatgcctgcttccgcttccatgtccaacaattctaaccaacaaaggacctagacagcccaccaagtcacttggttcccactcccagattttgcttttatttaacttaattttttatgtaggtgagttatattttctttcttttctgatcaggttattggtgacttactggactggcaccgccaggagaaaattctcctgctaactttttttcttaagctttctgtcaaacaatgaggttgtagggggaggtagggaagaatgagctgaatttgtagcatacagcttacctgctagaatgttcttaccctcttacctctcctgtagcgttagctctgcagagctaagctttgggagaatgaatctatcactgagaagttttactactcattgaagcacaaaaatatccgctacacaggttcacatcagggtaggatcgttaggatggctctataattaggataggccagaaccctggccactgtataaaattggaaagtctctaagacacaggcaaaccaggggacttaatgatttggttcgtttatttaataaaagcttttaattgagaacctactattgaccaggcactgttcaagacactagaacattatgttctagacactgtggggacacagtggtgaacagacaggcatggtctctgcccttcggagcttatattccagtaggagaaaaagcaaaaataaaataattataaatggtcatatgtactagaaaggaaatgggcaagggtcaaagagactcatgggcaagatctttcaggcttcctagaatgatgctaaaaatccacacattctggccatagcaccagaaatgtaccaactcaatgccttttcagctgcactatttaattatggtacctgctgccactcatcacagagcccttcttggtagaaatgatgtcagcattcttatttgctgatgctgctatgataccacgccttaaaaattgacagttgaaaaaaaaaagagtgaccagagggcaaaggacccattctcagtaatgggagatcttgagttgcagtccacagcattcacattctcaggataaacatgcttgtctccatatatactatctgtgcctgttatgaatgaaaaatccatccactctgctgccattcacagcctaattttctggagtagtccaaacaatgtttggaaaaacatgggactgtatgtcattactatgactgatagcagaataataatgcatcttacttctatatagagatagacttacataggttacccttgaaattcattagtttgtcataaagttttaggaaaggtaggacccggaaagaagttctaattagttgtctaaatatttttcagtgagccaagaaattcaccatgaaaaaacaagaataacaaatagaagggaagagataggatgggaaagctaacaaattaaagttttggcaaaaaggaatatatgtaaatagctaattatttacttttgtgcttactttatttagattatttctatcagttacaatctttttctagttaagtgtacctaatttatggaatgggtgctatcctgtttatgtgtgtcttggtttttcttggctacagaaaaactgttgcagggcaacactagtttgatatttgatttactctccaatgagactcaatggctgggccgtggtagactcatagttcctcttgttctttattaaattcatcctgctaattagatttctagtgacttgtaacatgtagtttacactgaattgcaattacagatgcatacaactactatactagaaaaaattgtcatttctgatgtgccaataaatgatttttatgagagaataaaaaaaaaaaaaaaaaaaaaa

SEQ ID NO: 2952 - DNA, 82027 bp, Homo sapiens
agcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcaagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgatttaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatcacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagagtacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaagctcctgaatcaattttgcatgagaggattgaacaagagattgagatggaaatgaaagagttttctagttcttttctgtctgccgaggaagaaggacttcatagcgccgaacttcaattatctaaaataaatgaaacacttgaacttttgtctgaatctccagtttactcaactaaatttgattccgaaaaggaaggcactggcccaattttcatcaaagaagtgtcaaatgctgatataagcatgggggatgtggctacactgtctgtaactgtcattggcatccccaaacctaaaattcagtggttctttaatggagtgctattaaccccttctgctgactacaaatttgtttttgacggtgatgatcatagcctgatcattctgttcaccaaattggaggatgagggagagtatacatgtatggccagtaatgactatggaaagacaatatgtagtgcctatctaaaaattaattccaaaggagagggtcacaaagacactgaaacagaatcagcagtggcaaaatctctggaaaagctgggaggtccttgtcctcctcacttccttaaggagttaaaaccaattcgctgtgctcaagggcttcctgccatctttgagtacacagtggttggagagcctgcccctactgttacatggttcaaagaaaacaagcagctttgcaccagtgtttattacactatcattcataaccctaatggctctggaactttcattgtcaatgaccctcagagggaagacagtggcctctatatctgtaaagcagagaatatgttgggtgagtccacctgtgcagcagagctgcttgtgcttctggaagacacagacatgactgataccccctgcaaagcaaagtccacaccagaggctcctgaggattttccacagacacccttaaagggtcccgcagttgaagcacttgactcagagcaggaaattgcaacgtttgtaaaagacaccattttgaaagctgctttaattacagaagaaaaccagcaactatcttatgagcatattgctaaagccaatgaattgagcagtcagcttcctttgggagctcaggaattgcaatccattttggagcaagacaagctcactcctgaaagcaccagggaatttctttgcatcaatggcagtattcactttcagcctctcaaggaaccatctcccaacctacagctgcagattgtacagtcccagaaaaccttctccaaagaaggtattctaatgcctgaagagcctgagacacaggcagttctatcagataccgagaaaatcttcccaagtgccatgtccatagaacaaattaattcattaacagttgagcctctgaaaactttattagctgaacctgaagggaattatccacagtcttcaatagaacctccaatgcattcttatctaacctctgtggctgaggaagtactttcaccaaaagaaaagacagtatctgacaccaacagagagcaaagagtgactcttcaaaagcaagaggcacaaagtgcgctcatcttgagtcagagcttagctgagggacacgtggagagtctccagagtcctgatgtcatgatctctcaggtaaactatgagcccctagtcccttcagaacactcatgcacagaaggaggtaaaattttgatagaaagtgcaaatccactggaaaatgcagggcaagattctgcggtcagaattgaggaaggcaagtccttaagatttccactagcacttgaagaaaagcaggtactgctcaaagaagagcattctgacaacgtggtgatgcccccagaccaaatcattgagtctaaaagagagcccgtggcaataaagaaagtgcaggaggtacagggaagggaccttctttctaaggaaagcttgctttctggtattccagaagagcagagattaaacctgaaaattcaaatctgccgggctttgcaagcagccgtggccagcgagcagccaggtcttttctctgagtggctaagaaatattgaaaaggtggaggtcgaggctgtaaacatcacccaagagcccagacacatcatgtgcatgtaccttgttacttcggcaaagtctgtaacagaagaagtaaccatcattattgaagatgttgatcctcaaatggctaacctgaaaatggaacttagggatgctttgtgtgctattatatatgaggaaatagacatcctaacagctgagggtcctagaattcagcaaggagccaaaacaagtttgcaagaagaaatggattctttttcaggttcacagaaggttgaacccattactgaaccagaagttgaatctaaatatctgatctcaactgaagaggtcagttattttaacgtgcaaagtagggttaaatatttggatgccacacctgtcactaaaggggttgcttcagctgttgtctctgacgaaaaacaagatgagagtctgaaaccatcagaggaaaaagaggagtcttcctctgaaagtggtactgaggaggttgctacagtaaagatacaggaagctgagggtggcttaatcaaagaggatggccccatgatacatacacctttagtggacactgtttctgaggaaggtgatattgtacacctcacaacatccataacaaatgctaaagaggtgaattggtattttgagaataaactggtgccttcagatgaaaagttcaagtgtttacaagatcaaaatacatatacgctagtcatcgacaaagtaaataccgaagaccatcaaggagagtatgtctgtgaggccttgaatgacagcggaaaaacagcaacttcagccaaactcactgtagtaaaaagagctgccccagtgatcaagaggaaaatcgaacccctggaagtagcactgggccacctagccaaattcacctgtgagatccaaagtgctcccaatgtccggttccagtggtttaaagctggccgagaaatttatgagagtgacaagtgttctattcgatcttcaaagtatatctccagccttgaaatcctgagaacccaggtggttgactgcggcgagtatacatgcaaagcttccaatgagtatggcagtgtcagctgtacagccacactaactgtgacagtgcctggaggtgaaaagaaagttcgcaaattacttccggaacgtaaacctgaaccaaaggaagaagttgttctgaaaagcgttctaagaaaaagacctgaagaagaagaacctaaagtagaacctaaaaaactagaaaaagttaaaaaacctgcagtaccagaaccaccacctccaaaacctgttgaagaggttgaagtacctactgttacaaaaagggaaaggaagattcctgaaccaacaaaagtgcctgaaatcaagccagcaatacctctccctgcacctgaaccgaaaccaaagcccgaagcagaagtgaaaacaatcaaaccacctcctgtggaacctgaaccaacccccatcgctgccccagtaacagtgccagtggttggaaagaaagcagaagccaaagcacctaaggaagaggctgccaagccaaaaggtcctatcaaaggtgtacccaaaaagactccttcaccaatagaagccgaaaggagaaagttaaggccaggaagtggtggagagaaacctcctgatgaagccccgttcacctaccagctaaaggctgtgccactgaagtttgtgaaagaaatcaaagacatcatcttgacagaatcagagttcgttggctcttcagcaatctttgaatgtttggtctccccttccactgcaattacaacctggatgaaagacggtagcaatatccgtgagagtcccaagcacaggtttattgcagatggtaaagacagaaagctgcacatcattgatgttcaactttccgatgctggtgaatacacctgtgttttacgtttgggaaacaaagaaaagacctccacggctaaacttgttgtagaagaacttcctgtgcgttttgtaaaaacactggaagaggaagtcacagtggtcaaaggacagccattgtacttgagctgcgagttaaacaaagagcgtgacgtggtctggaggaaggatggcaagattgtggtggagaaacctggccgaattgtgccaggcgtcattggcttgatgcgggctctgaccatcaacgatgcagatgacacagatgctggaacatacacagttactgtggaaaacgccaacaacctggagtgttcatcttgcgtaaaagtagtagaagtcattagagattggctggtgaaacctatacgagaccagcatgtgaaacccaaggggacagctatttttgcctgtgatatagcaaaagatactccaaacattaagtggttcaaaggatatgatgaaatccctgcggaaccaaatgataagactgaaatactgagagatggaaatcatctgtacctcaaaattaagaatgctatgccagaagatattgctgagtatgcagtggaaattgaaggaaaaagataccctgcaaagctgacacttggagagcgtgaagttgaactgcttaaaccaatagaggacgttaccatttatgagaaagaaagtgcaagctttgatgcagaaatctcagaggcagacattcctggacaatggaaactgaaaggagaacttctaaggccctcacctacttgtgaaatcaaagcagaaggtggaaaacgcttcttaactttgcacaaagtcaaactggaccaagctggtgaagtcctctaccaggcccttaatgcaattacaactgccattttgacagtaaaagaaatcgaacttgactttgctgtgcccctgaaggatgtcactgttccagaaaggcgacaggctcgattcgaatgtgtcctcacccgagaggcaaatgttatatggtccaaaggacctgatataattaagtcatctgacaaatttgatatcatcgctgatggaaagaaacatattcttgttattaatgattctcaatttgatgatgaaggggtctatactgctgaggtggagggcaagaagacctcagctcggttgtttgtcacaggtataagactgaaattcatgtcacctcttgaagatcaaacagtaaaagaaggtgaaacagcaacttttgtttgtgaactttctcatgaaaaaatgcatgtagtctggttcaaaaatgatgccaaactccatacaagcagaacagtactcatctcttctgagggcaagactcacaaattggaaatgaaagaagtgacattggatgatatatctcagataaaagctcaagtcaaggagctgagctccacagcacagctgaaggtcttagaggccgatccctacttcactgtgaaattacatgacaaaactgcagtggagaaggatgagattactttgaagtgtgaagtgagcaaagatgtaccagtgaaatggttcaaagatggtgaagagattgtcccttcacccaaatattctatcaaggcagatggcctgcgccgcatcttaaaaatcaaaaaggcggaccttaaagataaaggcgaatatgtgtgtgactgtggcacagacaagaccaaggcaaatgttactgttgaggctcgactaataaaagtggaaaagcctctgtacggagtagaggtgtttgttggtgaaacagcccactttgaaattgaactttctgaacctgatgttcacggccagtggaagctgaaaggacagcctttgacagcttcccctgactgtgaaatcattgaggatggaaagaagcatattctgatccttcataactgtcagctgggtatgacaggagaggtttccttccaggctgctaatgccaaatctgcagccaatctgaaagtgaaagaattgcctcttatcttcatcacacctctcagtgatgttaaagtcttcgagaaagatgaggctaagtttgagtgtgaagtatccagggagcccaaaacattccgttggctaaaaggaacccaggaaatcacaggtgatgacagatttgagcttataaaggatggcactaagcattcaatggtgatcaagtcagctgcttttgaagatgaagcaaaatacatgtttgaagctgaagataagcacacaagtggcaaactgatcattgaaggaatccggctcaaattcctcacccctctcaaagatgtaactgccaaagagaaggaaagtgctgtatttactgtggagttatctcatgataacatccgagttaaatggttcaagaatgaccagcgcctacacaccaccaggtcggtctcaatgcaagacgaagggaaaactcattcgatcacattcaaagacctgtctattgatgacacctcccaaattagagtagaagctatggggatgagttcagaagctaaactcactgtgcttgagggagacccatattttacaggaaaacttcaagattatactggtgtagagaaagatgaagttattctacagtgtgaaattagcaaagcagatgcaccagtgaaatggtttaaggatgggaaggaaataaagccatccaaaaatgctgttattaaggcagatggcaagaaacgcatgctaatcctaaagaaagccttgaaatcagatattggacagtacacctgtgactgtgggacagataagacctcaggaaaacttgacattgaggatcgggaaattaaactggtgcgacccctgcacagtgtggaggtgatggagactgagacagcacgctttgaaaccgaaatctctgaagatgatatccacgccaactggaaactcaagggagaggccctactccaaacacctgattgtgaaattaaggaagaaggcaaaatacactcccttgttttgcacaactgtcgcctggaccagacgggtggggtggatttccaagctgccaatgttaaatctagtgcccacctccgagttaagccacgagtaattggtcttctgaggcctttaaaggatgtcaccgtgactgcaggggaaacagccaccttcgactgcgagctctcctacgaagatatcccagtggaatggtatctcaaagggaagaaactagagcccagcgataaggtggtcccacgttcagaaggaaaagttcatacacttactctgagggatgtaaagttagaagatgctggggaagtccaactaacagcaaaagatttcaaaactcacgccaacctctttgtgaaagaacccccagttgaattcactaagcctcttgaggaccagacggtcgaagagggagccactgcagtgctggagtgtgaagtctccagagaaaatgctaaggtgaaatggttcaaaaatgggacagaaatcctcaaaagcaagaagtatgaaattgttgctgatggcagggtcagaaaacttgttatacatgactgtaccccagaggatattaaaacatacacttgtgatgctaaggattttaagacttcctgtaacctgaatgtcgtgcctcctcatgtggaattcttaagaccactcaccgaccttcaagttagagaaaaagaaatggctcgatttgagtgtgaactttcccgagaaaatgctaaggttaagtggtttaaagatggtgctgaaattaaaaagggcaaaaaatatgacatcatatccaagggagcagtgcgcattcttgtcatcaacaaatgtctactggatgatgaagctgaatattcctgtgaagtaaggacagcgagaacttctggcatgctgacagttctggaagaagaagctgtctttaccaaaaatcttgccaacattgaagttagtgaaacagacactataaaactggtttgtgaagtctccaaacctggcgcagaagtgatttggtataaaggggatgaggagatcattgaaacaggaagatatgaaatactgactgaaggacggaagagaatcctggtcattcagaacgctcaccttgaggatgctggcaactacaactgtcgactcccaagctctcgaaccgatggcaaagtcaaagtacatgaactggctgctgaatttatctcaaagcctcaaaaccttgaaatacttgaaggagaaaaggctgaatttgtctgctctatatcaaaagaaagctttccagtccagtggaagagggatgataagacacttgaatctggagataaatatgacgttattgctgatggtaaaaagagggtcctagttgtgaaagatgccacattacaagatatgggcacttacgttgtcatggtaggggccgccagagcagcagctcacttgacagtcattgaaaaactcaggatcgtagttcctcttaaggacacccgggtgaaggaacaacaggaagttgtcttcaactgtgaagtcaatactgaaggtgccaaagccaaatggttcagaaatgaagaagctatatttgatagttcaaaatacatcattctccaaaaagacctagtctacaccctcagaattagagatgcacacttagatgaccaagccaactataatgtgtctttgaccaatcacagaggtgaaaatgttaaaagtgcagccaatctaatagtagaagaggaagaccttaggattgttgagcctcttaaagatattgaaacaatggagaagaaatctgtcacattctggtgcaaggtgaatcgtctcaatgtaacactgaagtggaccaaaaatggtgaagaagtgccttttgacaaccgtgtctcatacagagttgataagtacaagcacatgttaaccattaaagactgtggcttcccagatgaaggtgaatacattgtcactgctggacaagataaatctgttgctgagcttctcatcatagaagccccgacagaatttgtggaacacttggaagatcagacagtcactgagttcgatgacgctgtcttctcctgccagctctccagagagaaagccaatgtaaaatggtacagaaatgggagagaaatcaaagaaggcaaaaaatacaaatttgaaaaagatggaagtatacacagactcattataaaagattgcaggctggatgatgagtgtgaatatgcttgcggggtagaagacaggaagtctcgtgctagactttttgtggaagaaattcctgttgagatcatcaggcctccacaagatattcttgaagcccctggtgctgatgttgtctttttagcagaactcaataaagataaggtggaagtccaatggctaagaaataacatggttgttgtccagggtgataaacaccagatgatgagtgaaggaaagatacatcgactacagatttgtgatattaagccccgtgaccagggtgaatacagatttattgccaaagacaaagaagccagagctaagcttgaactggcagctgcaccaaaaatcaagacagctgaccaagaccttgtggttgatgttggcaagcctctgacaatggtggtgccatatgatgcctaccccaaagcagaagctgaatggtttaaagaaaatgaacctttatctacaaaaaccattgatactacggctgaacaaacttctttcagaattttagaagccaagaaaggagacaaagggaggtataaaattgtgcttcagaacaaacatggaaaagcagaaggattcatcaatttaaaagttattgatgttcctgggccagtacgtaacttagaagtgacagaaacatttgatggtgaagtgagccttgcttgggaagaacctttaactgatggtggaagcaaaatcataggttacgttgttgaaagacgtgacattaagagaaagacctgggttctggccacagaccgtgcagagagttgtgagtttactgtcactggtctacagaaaggaggagttgagtacctattccgtgtgagtgcaagaaacagagttggcactggtgagccagtagaaactgacaatcctgtagaagcaaggagtaaatatgatgttccaggccctcctttgaatgtaaccatcactgatgtgaatcgatttggtgtctcactgacatgggaaccaccagagtatgatggaggtgctgagatcacaaactacgtcattgaattaagagacaagacttctatcaggtgggatactgccatgactgtgagagctgaagacctgtctgcaactgttactgatgtggtagaaggacaggagtacagtttccgagtgagagcccaaaatcgaattggagttggaaaaccaagtgcagccacacccttcgtcaaagttgctgatccaattgagagaccaagtcctcctgtaaacctaacttcctcagatcagactcagtcatcagttcagctcaaatgggaacctcctctgaaagatggaggaagcccaatattaggctatataattgagcgatgcgaagaaggaaaagataattggattcgttgcaatatgaaacttgtccctgaactgacttacaaggttaccggattggaaaaaggaaataaatatttatatagagtatctgcagaaaataaagctggtgtttcagatccatctgaaattcttggtcctctcaccgctgacgatgcatttgttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattgctcgcccaagtgcacccaaagaattgaaatttggtgatataaccaaggactcagtacatttgacttgggaaccacctgatgatgatggaggaagtccgttaactggatacgttgttgaaaaacgagaagtcagccggaaaacatggactaaagttatggactttgtgactgatctagaattcacagttcctgatcttgttcaaggaaaagagtacttatttaaagtttgtgctcgtaacaaatgtggccctggagaacctgcatatgttgatgaacctgtaaatatgtcaactcctgcaacggtacctgacccaccagagaatgttaaatggagagatcgaacagccaatagcatcttcttaacatgggatccacctaaaaatgatggtggttcacgcatcaaaggatatatagttgaaagatgtccacgtggttctgataaatgggttgcctgtggagaacctgttgcagaaacaaaaatggaagtgacaggtcttgaggaaggcaaatggtatgcctaccgcgtgaaggccttaaacaggcagggtgctagcaaaccaagcagacccacagaggaaatccaggctgtggacacacaagaggccccagaaatcttcctcgatgtgaagctccttgctggtctcactgtaaaagctgggaccaagattgaacttcctgccaccgtaaccggaaaacctgaacctaaaataacttggacaaaggctgatatgattctgaagcaggacaaaagaattaccattgaaaatgtccctaagaaatccacagtgactattgttgatagtaagagaagtgacactggcacatatatcattgaggctgtgaatgtgtgtggccgggccactgctgtggtggaagtgaacgtcttagataaacccggaccaccagctgcctttgacatcacagatgtaaccaatgagtcatgtcttctaacatggaacccaccacgcgatgatggtggatctaagatcacaaactatgttgtggagagacgagcaactgatagtgaagtgtggcacaagctctcatccaccgtcaaggatacaaacttcaaggccaccaaattaatccccaataaagagtacatcttcagagttgctgcagaaaacatgtatggtgttggtgaaccagttcaggcctctccaataacagccaaatatcagtttgatccacctggtcctccaactcgcctagaaccttctgatatcactaaagacgcagtgactctcacatggtgtgagccagatgatgatggtggcagcccaatcacaggatactgggttgaaagactggatcctgatacagataaatgggttagatgcaataagatgccagtaaaggacacaacatacagagtgaaaggtctcactaataagaaaaaatacagattccgtgtgttggctgaaaatcttgctggacctggaaaaccaagcaaatcaactgaaccaatcttaataaaggatcccatagatcctccatggccccctggaaaaccaactgtaaaagatgtaggcaaaacatcagtaaggttgaattggacaaaaccagaacatgatggaggtgcaaagattgagtcttatgtcattgaaatgctgaagactggaacagatgagtgggtcagagtggcggaaggggttcccaccactcagcacttgctcccagggctcatggaaggacaggaatactcattccgagttagagctgtgaataaggctggggaaagtgaacccagtgaacccagtgaccctgtgctttgccgggagaagctatatcctccatcaccaccacgctggcttgaagttattaatatcacaaaaaatacagcagacctaaaatggacagttcctgagaaagatggagggtcccccatcaccaactacattgtggaaaagagagacgtcaggcgaaaaggctggcaaacagtggataccactgtcaaggacaccaagtgcacagtcaccccactgactgagggctctttatatgtgttccgagttgctgcagaaaatgctataggacaaagcgactacaccgaaattgaggactctgtgctggccaaagacacctttaccactcctggaccaccctacgccctggcagtggttgatgtgacaaaacgacatgttgacctaaagtgggagccacctaaaaatgatggtggaagaccaatacagagatatgtcattgagaagaaagaaaggttaggtacccgttgggtgaaagctggaaagactgcaggacctgactgtaacttcagagtaactgatgtcatcgaaggaacagaggtccagtttcaggttcgggctgaaaatgaagctggagttggccacccaagtgaacccacagaaatcctatccattgaagatccaacaagtcctccctcaccaccccttgacctacatgtgactgatgctgggagaaaacacattgccattgcttggaagcctccagagaaaaatggtggaagtcctatcataggataccatgttgaaatgtgtccagtaggcactgagaaatggatgagagttaattctcgcccaataaaggacttgaaattcaaggttgaagaaggtgttgttcctgacaaagaatatgtcctgagagtgagagcagtcaatgctattggtgtcagcgagccatctgaaatctctgaaaatgtggttgccaaagacccagactgcaagccaacaattgacctggagactcatgacattattgttattgaaggtgaaaagttaagcattcctgttcccttcagagctgtcccagttccaactgttagttggcataaagatggcaaagaagttaaagcaagtgatagattaacaatgaagaatgatcacatctctgcacaccttgaagttcccaagagtgtccgtgcagatgccggaatttataccattacactggagaataagctcggctcagcaacagcctcaatcaatgtcaaagtcataggcctacctggaccatgcaaagatattaaagcaagtgacattaccaagagttcttgtaagttaacttgggaacctccagaatttgatggtggaaccccaattcttcattatgtcctggagcgcagagaagctgggaggagaacatatataccagtcatgtctggtgagaacaaactgtcatggactgtgaaggatctcataccaaatggtgaatacttcttccgtgttaaagcagtcaacaaggttggtggaggagaatatattgaactgaaaaatccagtcattgctcaagatccaaagcaaccccctgatccacctgtagatgtagaggttcataatcctacagcggaggcaatgactattacatggaagccacctttgtatgatggagggagcaagataatgggctacatcatagagaagattgctaagggtgaagaaaggtggaagagatgcaatgaacacctggtaccaatcctgacctatacagcaaaaggacttgaagaggggaaagagtaccaattccgtgtgcgagcagagaacgccgcgggtattagtgaaccttctcgggctactcctccaaccaaagctgtagatcccattgatgcccccaaagtcattctgagaacaagcctagaagtgaaacgaggtgatgaaatagcacttgatgcaagtatttctggatcaccttacccaactattacatggataaaggatgaaaatgttattgtaccagaggaaattaagaagcgtgcagcacccttggttaggagaaggaagggtgaagttcaagaagaagaaccatttgtcctgcctctgacacagcgtttgagtattgacaacagcaaaaagggagaatctcagctacgcgtccgagattctctccgacctgaccatggtctgtatatgatcaaagttgaaaatgaccacggtattgcaaaagctccttgtactgtcagtgtgttagatacaccgggaccaccaatcaactttgtatttgaagatatcagaaagacctcagtcctttgtaaatgggaaccaccccttgatgatggtggcagtgaaatcataaactacactttggaaaagaaagacaagacaaaacccgactcagaatggattgttgtcacttcaacacttagacattgcaaatattcagtaacaaaactgattgaaggaaaagagtacctcttccgtgtaagagctgaaaacagatttgggccaggtccaccatgtgtttcaaagccacttgtggctaaagatccatttggaccacctgatgcaccagataagcccattgtggaagatgttaccagcaacagtatgctagtgaaatggaatgaaccaaaagataatggaagccccattttgggttactggcttgaaaaacgtgaagttaacagtacacattggtctcgtgtcaacaaaagccttctgaatgccttgaaagccaatgtagatggcttattagaaggactcacctatgtcttcagagtatgtgctgaaaatgcagctggacctggaaagttcagtccaccttcagatcccaaaacagcacatgatccaatctctcctcctgggccacctatcccaagagtcactgacacaagctctacaactattgaactagaatgggaacccccagctttcaatggtggtggggaaattgttggctattttgttgataagcagttggttggcacaaatgaatggtcacgctgcacagagaagatgatcaaggtccgtcagtacaccgtcaaagaaatccgagagggtgctgattacaaacttcgggtgagtgctgtcaatgccgcaggggaaggaccgcctggagaaacacaacctgttactgtggctgaaccacaagagcctccagctgtggaactggatgtttctgtcaagggtggaatacaaataatggctgggaagactcttagaattccagctgtggtgactggtcgccctgtacctacaaaagtatggaccaaagaagaaggggagctggataaagaccgtgttgtaatagacaacgttggaaccaaatctgaactaattatcaaggatgcactgcgaaaagaccatggcagatatgtgattacagctacaaatagctgtggttccaaatttgcagcagccagggtagaagtttttgatgtccctggtccagttcttgacttaaaacctgttgtaacaaacagaaaaatgtgtctacttaactggtctgatccagaagatgatggaggaagtgaaataacaggctttatcattgaaagaaaagatgccaagatgcatacttggagacaaccaatagagactgagagatctaaatgtgacatcacaggtctgcttgagggacaagaatataagttccgtgttattgccaagaacaagtttggctgtggccctcctgttgaaataggaccaattcttgcagttgatccactaggtcctccaacatctccagagaggctcacatacactgaaaggacaaagtccactatcacacttgactggaaagagccccgcagtaatggtggcagtcccatccaaggatatatcattgaaaaacggcgtcatgacaaacctgactttgaaagagttaacaagcgactctgcccaaccacatcttttctggttgaaaatcttgatgaacaccaaatgtatgagttccgtgtcaaagctgtcaatgaaattggtgaaagtgaaccatccctacctcttaatgtagtcatacaagatgatgaagtgcctccaactattaagttgcgtctgagtgttcgaggagacactatcaaagttaaggcaggagagcctgtccacatccctgcagatgtgacaggccttccaatgcctaagattgaatggtccaaaaatgaaactgtaattgaaaaacccactgatgcacttcagataaccaaggaagaggtatcccgaagtgaggcaaaaactgagcttagcattcccaaagcggtccgggaggacaaaggcacttacacagttactgcttccaatcgccttggctcagtgttccgaaatgttcacgttgaagtatatgaccgcccatccccaccaagaaatcttgctgttactgacattaaagctgaatcttgctacttgacatgggatgcccctcttgataatggtggcagtgaaatcacccattatgttattgacaaacgtgatgcaagtaggaagaaagcagaatgggaggaagtcaccaacactgctgtagagaaaagatatgggatctggaaacttatccccaatggtcagtatgagttccgagtcagggcagtgaataaatatggaatcagtgatgagtgcaaatcagataaagtagtcattcaagatccttatcgccttcctggacctccaggaaaaccaaaagttttggcacgcaccaaaggatcaatgctagtgagctggactcctcctttggacaatggtggctctccaattactggctactggctggagaaaagagaagagggaagtccttattggtcacgtgttagccgagcaccaataaccaaagtgggattgaaaggcgtggaatttaatgttcctcgtttgcttgaaggcgttaaataccagttcagagccatggcaataaatgctgcaggaattggtcctcccagtgaaccatcagatccagaggttgcaggagatcccatatttccaccggggccaccttcttgcccagaagttaaagataaaacgaagtcaagcatctcactaggatggaaacctccagccaaagatggtggcagcccaatcaaaggatacattgtagaaatgcaagaagaaggtactactgactggaaaagagtaaatgaaccagacaaacttataactacctgtgaatgtgtggtgcctaatctgaaagagctcaggaagtacagattcagagtgaaagctgtcaatgaagctggtgaatctgaaccaagtgatacaactggggagatccctgccactgatattcaagaggaaccagaagttttcattgacattggagcacaggactgtctggtttgtaaagctggctcacagattaggattcctgctgtcatcaagggacgcccaacaccaaaatcatcttgggaatttgatggaaaggcaaagaaagcaatgaaggatggagttcatgacatacccgaagatgcacagctggagactgctgaaaactcctcagtaattattattccggagtgtaaacgatctcatacaggcaaatacagcatcacagccaagaataaagcaggacaaaagactgcaaattgcagagttaaagtcatggatgtaccaggcccacccaaagatctgaaagtcagtgatatcacaaggggtagttgcagactttcatggaagatgccagacgacgatggaggagacaggatcaaaggctatgttattgagaagaggactattgatggaaaagcctggaccaaagtcaatccagactgtggaagcaccacatttgtagtgcctgatctcctctctgaacagcaatatttcttccgtgtgcgagcagaaaaccgttttggtattggcccacctgtggaaaccattcagaggaccactgccagagatccgatatatcctcctgatcctcctattaaactcaagattggcctcatcacaaagaacacagtgcatctgtcatggaaacccccgaagaatgatgggggctcccctgttacccactatattgttgagtgccttgcatgggaccctactgggacaaagaaagaagcctggaggcagtgcaataagcgtgatgtggaagaactgcaatttactgttgaagacctagtagaaggtggggaatatgaattccgagtcaaagctgtcaatgctgcaggagtcagcaagccttcagccactgttgggccctgtgactgtcaaagaccagacatgccaccatcaattgatctaaaagaattcatggaggttgaagaaggaaccaatgttaacattgtggccaaaattaaaggtgtgccattcccgacactaacctggtttaaagctcctccaaagaagcctgataacaaagaacctgttctctatgacacccatgtcaacaaactggtggtagatgatacttgcactttagttattccgcagtctcgcaggagtgacactggcttatataccatcacagctgtaaataatctgggaacagcatcaaaggagatgagactgaatgtcctgggtcgtcctggccctccagtgggacccataaaatttgaatctgtttcagcagatcaaatgacactatcttggtttccacctaaagatgatggtgggtctaagattacaaactatgtaattgagaaaagagaagctaacaggaagacatgggtccatgtctccagtgaacctaaggagtgcacgtacacgattcccaaattgctagaaggccatgaatatgtattccgaatcatggcccagaataaatatggcattggagaacctcttgacagtgaacctgaaacagcaagaaacctcttctctgtccctggagcaccagataaaccaacagttagcagcgtgactcgtaactccatgactgtcaactgggaagagccagaatatgatggaggctctcctgtgacagggtactggctggaaatgaaagacaccacttcaaagagatggaagagagttaaccgagatcctatcaaagccatgactttgggtgtttcttataaagtgactggtcttattgaaggttccgactatcaattccgggtatatgcaatcaatgctgctggcgtgggtccagcaagtctgccatcagacccagcgactgctagagatccaattgcccctcctggtcctccatttcccaaagtgacagattggactaaatcatctgcagatctggagtggtctcccccactaaaagatggtggatccaaagtaactggatacatcgttgaatataaagaagaaggaaaagaagaatgggaaaagggtaaagataaagaagtgagaggaacaaagctcgttgtgacaggattaaaggaaggagcattctacaaatttagagttagtgcagtcaacattgctggcattggagaacctggagaggtcacagatgtcattgaaatgaaggacagacttgtttcacctgaccttcagctagatgccagtgtcagagatagaattgttgtccatgctggaggggtgatccgaatcattgcctatgtgtctggaaagcctcctccaaccgtcacctggaacatgaatgaaagaaccttacctcaagaagccaccattgagaccacagccattagctcatccatggtcatcaagaactgccagaggagccatcaaggcgtctattctcttcttgccaaaaatgaagccggagaaagaaagaagacaattattgttgatgtattagatgttccaggtcccgttggaacaccattcctagctcacaacctaaccaatgagtcctgcaaactgacatggttttctccagaagatgatggaggctctccaatcaccaattatgtcattgaaaagcgtgaatctgaccgcagagcatggaccccagtgacatatacagttacccgacaaaatgctactgtccagggtctcattcaaggaaaagcctactttttccgaattgcggctgaaaatagtattggcatgggtccatttgttgagacatcagaggcacttgttatcagagagccaataactgtaccagagcgtcctgaagacctggaagtcaaagaagttactaaaaatactgtaactttgacttggaatcctcctaagtatgatggtgggtcagaaattattaactatgtcctagaaagtcggctcattgggactgagaagttccacaaagttacaaatgacaacttgcttagcagaaaatacactgttaaaggcttaaaagaaggtgatacctatgagtaccgtgtcagtgctgtcaacattgttggacaaggcaaaccatcattttgcaccaaaccaattacttgcaaggatgagctggcacccccaacgcttcacctcgacttcagagataagctcacgattcgagttggtgaagcttttgccctcactggccgttactcaggcaaaccaaagcctaaggtttcctggttcaaagatgaagctgatgtgctggaagatgatcgcactcatataaagactacaccagcaacacttgctttagagaagatcaaggccaaacgttcagattccggcaaatactgtgtggttgtggagaacagtacaggctctaggaaaggtttctgtcaagttaatgttgttgaccgtcctggaccaccagtaggaccagttagttttgatgaggtgaccaaagattacatggttatctcttggaagcctcctttagatgatggaggcagtaaaatcaccaattatattattgagaagaaggaagtgggtaaagacgtctggatgccagtgacatctgcaagtgctaaaacaacatgcaaagtttctaaactacttgaaggaaaagattatattttccggatacatgctgaaaatctgtatggaataagtgatcctctggtgtctgattcaatgaaagccaaagatcgtttcagggttcctgatgcacctgatcagccaattgttacagaagttaccaaagactctgcattagtaacctggaataagccacatgatggaggaaaacccatcacaaactacatcctggaaaagagagaaactatgtctaaacgatgggctagagttaccaaagatcctattcatccatacactaaatttagggttcctgatcttctagaaggatgtcagtatgaattccgggtttctgcagaaaatgaaattggtattggagatccaagcccaccatccaaaccagtctttgctaaagatccaattgctaaaccaagtccacctgttaatcctgaagcaatagatacaacatgcaattcagtcgatctaacttggcagccaccacgtcatgatggtgggagcaagattctgggttatattgttgagtaccagaaagttggagatgaagagtggagaagagccaatcacacccctgagtcatgtcctgaaactaaatataaagtcaccggtcttcgggacggtcaaacctataagtttagagtgttagcagtcaatgcagctggtgaatcagatccagctcatgttccggagccagtcctagtaaaagacaggcttgaaccccctgagttgattcttgatgccaacatggcaagagaacaacacattaaagttggtgatactctaagacttagtgccatcatcaaaggagtgccattcccaaaagtaacttggaaaaaagaagacagagatgctccaactaaagcaagaattgatgtgactccagttggtagcaagcttgaaattcgtaatgctgcccatgaagatggtggaatttattctttaacagtggagaatccagctggttcaaaaactgtctcagtaaaagtacttgtattagataaacctgggccacctagagatctggaagtcagtgaaattaggaaagattcatgttaccttacttggaaagaaccactggatgatggtggttctgttattaccaattatgtggttgagaggagagatgttgccagcgcccagtggtcacctctctcagctacatcaaagaaaaagagtcacttcgctaagcatctgaatgaaggcaaccagtacctcttccgagtagctgcggagaaccagtatggacgtggtccttttgttgaaacaccaaaaccaatcaaggctttggatcctctccatcccccagggccacccaaggacctgcaccatgtagatgttgacaagactgaagtctccctagtctggaataagccggatcgtgatggtggttctccaatcactggatatttggtagaatatcaagaagaaggcacccaggactggattaaatttaagactgtgacaaacttagagtgtgtggttactggactacaacaaggaaagacctatagattccgtgtaaaagctgaaaacattgtgggtcttggtctccctgacacaactatcccgatagaatgtcaagaaaaactagtgcctccatccgtggagctagatgtgaaattaattgaaggtcttgtggtaaaggctggaaccacagtcagattccctgctattataagaggtgtgcctgttcctactgcaaagtggacaaccgatgggagtgagattaaaaccgatgagcactacacagttgaaacagacaacttctcatcagtacttaccattaagaactgcttaaggagagacactggggaatatcaaatcacagtttccaatgcagccggtagcaaaacagtagccgtacatcttactgttcttgatgttcctgggccaccaacaggtcctattaatattctggatgttactcctgaacacatgactatctcatggcagccacctaaggatgatggaggaagccctgtgataaattatattgttgagaaacaagatacaaggaaagacacgtggggtgttgtctcttccggaagcagtaagacaaagctgaaaatcccacatctgcagaagggctgtgaatatgttttccgagttagagcagagaataagataggtgttggtcctccccttgactccacacctactgttgctaagcataaatttagtcctccgtctcctcctggtaaaccagtggttactgacattactgaaaatgcagcaacagtgtcttggaccctgccaaaatctgatggtggcagtccaataactggctactatatggaacgtcgagaagtaactggcaaatgggtgagggtcaacaaaacacctatcgctgacctgaagttcagagtgactggactctatgaaggaaatacatatgagtttagagtttttgctgaaaatcttgcaggactaagcaaaccatccccaagttctgatccaataaaagcttgccggcccatcaaaccacctggaccacctattaatcctaaactgaaagacaagagcagagaaacagctgatttggtgtggacaaagcctctcagtgatggtggtagccccattctaggatatgtagtggaatgtcagaaacctggcacggcacaatggaacaggattaataaagatgaactcattaggcaatgtgcctttagggtacctggactaattgaaggaaatgagtacagattccgtataaaggcagctaatattgtaggagagggtgagccaagagaactagcagaatctgtgattgcaaaagatatccttcatcctccagaagtagaacttgatgttacttgtcgtgatgttattaccgtgagagtaggccaaactatccgcattctagctcgagtcaaaggcagacctgaaccagacataacttggactaaggaaggcaaagtattggtccgagaaaagagggtggaccttattcaggatctacctcgtgttgagttacaaattaaagaagctgttagagctgatcatggcaagtatatcatctcagctaagaacagcagtggacatgcccaaggttcagccatcgttaacgtccttgacagacctgggccttgccagaatttgaaggttaccaatgtaaccaaagagaactgtacaatttcttgggaaaacccactagataatggtggctcagaaataacaaacttcatagtagaatatcgcaaaccaaaccagaaaggctggtcaattgttgcatcagatgtcactaaacgattaatcaaggccaaccttttagccaacaatgaatactatttccgagtttgtgcagagaataaagtaggtgttgggccaaccatcgaaacaaaaactcccattctggctattaaccctattgacagaccaggtgagcctgaaaaccttcacattgcagataaaggaaagacatttgtctatctaaagtggcggaggcctgactatgatggtggcagtccaaatctgtcatatcatgttgagagaaggcttaagggctccgatgactgggaaagagtgcataaaggaagcattaaagaaactcactacatggttgacagatgtgttgaaaaccagatttatgagttcagagtgcaaacaaagaatgaaggtggggaaagtgactgggtgaagacagaggaagttgttgtgaaagaagacttacaaaaaccagtacttgatctgaaattaagtggggtcctaactgtcaaagcaggggacaccattaggcttgaggcaggggttagaggcaaaccattcccagaagttgcatggaccaaggacaaagacgctacagacttaacaagatcaccaagggtcaagattgatacccgtgctgattcatctaaattttctcttactaaagcaaagcgaagtgatgggggtaaatatgtagttacggcaactaacacggctggcagttttgtggcctatgccactgtcaatgttttagataagcctggtcctgtgagaaatctgaaaattgttgatgtgtccagtgataggtgtactgtttgctgggatccaccagaagatgatggtggctgtgaaatccaaaattatattctagaaaaatgtgagacaaagcgaatggtttggtctacctattctgctactgtcttgacacctggtactacagtaacacgtctcatagaaggaaatgaatatattttcagagtccgtgcagaaaataaaataggcacagggcctccaacagaaagtaaaccagtcatagccaaaaccaagtatgataaacctggtcgccctgatcccccagaagtcactaaagtaagcaaagaagagatgactgtggtttggaatccacctgaatatgatggtggaaagtctataactggatactttttggagaaaaaggaaaagcattcaacacgatgggtccctgtcaacaagagtgcaatccctgagagacgtatgaaagtacagaatctcctcccagaccatgaatatcagttccgtgtcaaggcagaaaatgaaattggaattggagaaccaagcttgccttcaagaccggtggtggcaaaagaccccatagagccacctggtccaccaaccaatttcagagtggttgatacaaccaaacattccataactcttgggtggggaaaaccagtctatgatggtggtgcaccgatcattggatatgttgtggaaatgagaccaaaaatagcagatgcgtctcctgatgaaggctggaaacggtgtaatgctgcagcacagcttgtacgcaaggaattcactgttaccagcttggatgaaaaccaggaatatgagttcagggtgtgtgcccaaaaccaagttggtattgggcgccctgcagagctaaaggaagctatcaaacctaaagaaatactagaacctccggagattgatttggatgccagcatgaggaaactggtcatagtgagagcaggatgccctattcgtctctttgctatagtgagaggacgaccagcccctaaagtcacttggcgaaaagttggcattgataatgtggtcagaaaaggacaagttgatctggttgacactatggccttccttgtcatccccaattctacccgtgatgactcaggaaaatattccttaacacttgtgaacccagcaggagaaaaggctgtattcgtaaatgtcagagtattagacactcctgggcctgtgtctgatttaaaagtttcagatgtcactaaaacatcatgccatgtgtcctgggcccctcctgaaaacgacggtgggagccaagtgacacattatatcgtggagaaacgtgaggcagacagaaagacatggtcgaccgttaccccagaagttaagaaaacaagcttccatgtaaccaatcttgtccctgggaatgagtattacttcagagtaactgctgtcaacgaatatggccctggcgtcccaacagatgtcccaaaaccagtgcttgcatcagatcctctaagtgagccggatcccccaaggaaattagaagtgactgaaatgaccaagaacagtgccaccttagcctggttacctcccctacgtgatggaggtgctaaaatcgatggctacatcactagttacagagaagaagagcagcctgcagatcgctggacagagtactcagtggtaaaagatctgagccttgttgtcactggcctaaaggaaggaaagaaatacaaatttagagtagcggccagaaatgctgttggagtcagtttgccaagagaagctgaaggagtgtatgaagccaaagaacaactgttgccaccaaagatccttatgccagagcaaataactatcaaagctgggaaaaaactccgaattgaagcccatgtgtatggaaagcctcatcccacctgtaaatggaaaaaaggagaagatgaagttgtcacatccagccacctggcagtgcataaagcagacagctcttcaattctgatcataaaagatgtgactaggaaagacagtggttactacagcctcacagcagagaacagttctgggacagacactcagaaaatcaaagttgtagtcatggatgcccccggcccccctcagcctccatttgacatttctgatatagacgctgatgcttgctccctgtcatggcacatccctctggaggacggaggcagtaacatcaccaattatatagtggagaagtgtgatgtaagccgaggtgactgggtcacggctctagcttcagtcacaaaaacttcctgcagggttggaaagctgatcccaggccaggagtacatcttccgggtccgtgctgaaaaccgatttggcatttcagagcctctcacatctccaaagatggttgcgcagttcccatttggtgttcctagtgaaccaaagaatgcacgagtcaccaaagtcaacaaggactgtatttttgttgcttgggacagaccagatagtgatggagggagccccattattggttatctgattgaacgcaaggaaagaaacagtttgctgtgggtgaaagccaatgatactcttgtccggtcaactgaatatccttgtgctggccttgtagaaggtcttgagtattcattcagaatctatgccctaaacaaagctggatccagcccacccagcaaacccacagaatatgtaactgcaagaatgccagttgatcctcctgggaaacctgaggttattgatgtcaccaagagtactgtatctctgatctgggctcgtccaaagcatgatggaggcagtaaaattattggctatttcgtagaagcttgcaaacttcctggtgataaatgggtacggtgcaatactgcacctcaccagattccccaggaagagtacacagctactggcctagaagagaaagctcagtatcaatttagagctattgccaggaccgcggtaaacattagcccaccttctgaaccttctgatccagtgactatcctcgcagaaaatgtccctcccaggatagacctgagtgtggctatgaaatctttgcttactgtgaaagctggaactaatgtctgcttggatgctactgtttttggtaaaccgatgccaacagtttcttggaaaaaagatggcacactgctaaaaccagcagaaggcataaagatggccatgcagcggaatctgtgcaccttggagctattcagcgtgaaccggaaggactcaggagactataccattactgctgaaaattcaagtggttctaaatcagccaccattaagcttaaagtgttagataaaccgggtcctccagcatctgttaaaatcaacaaaatgtattcagatcgtgctatgctttcttgggaaccgcctcttgaagatggaggctcagaaatcaccaactatattgttgacaaacgtgaaacaagcaggcccaactgggctcaagtctctgcaactgtgcctatcaccagctgcagcgtggagaaacttatagagggccatgagtatcagttccgtatttgtgctgaaaataaatatggagtaggcgatccagtcttcactgaaccagcaattgccaaaaacccatatgacccaccaggacgctgtgatcctcctgttattagcaacataaccaaagatcacatgacagtcagctggaagccaccagcagatgatgggggctcacccatcactggctatttgcttgaaaagcgggaaacccaggctgttaactggactaaggtcaacagaaaacctattatagaaagaacattaaaagcaacaggtcttcaagaaggtaccgaatatgagttccgtgttacagctataaataaagctggaccaggcaaacccagtgacgcatccaaggccgcttatgctcgggaccctcagtatcctcctgcgccaccggctttccctaaagtatatgatacaactcgcagctctgtgagtctatcttggggcaagccagcctatgacggcggcagccctatcattggttatctcgttgaagtaaaacgggctgactccgataactgggtgaggtgcaacttaccacagaatctacagaaaacccgctttgaggttactggcctgatggaagacacacaatatcaattccgtgtgtatgccgttaataagattggatacagtgaccccagtgatgtgccagataaacactatcccaaggacatcttaattccacctgagggagaacttgatgcggacttaaggaagacactcatattacgtgctggagttactatgagactatatgtaccagtaaaaggacgcccacctccaaagattacttggtctaaaccaaatgtcaatctaagagacaggattggactggacataaagtcaactgactttgacactttcttgcgctgtgaaaatgtgaacaaatatgatgcaggaaaatatatcttaaccctggagaacagctgtggtaaaaaggaatataccattgttgtgaaagtgcttgatactcctgggccacctgtcaatgtgactgttaaggaaatatccaaagactctgcttatgttacctgggagcctcccattattgatggcggaagccccatcataaactatgtggtacaaaaacgtgatgcagagaggaaatcctggtctacagtgacaactgagtgctccaaaacaagcttcagagtagctaatttggaggagggaaaatcctacttcttccgagtgtttgctgaaaatgagtatggcattggtgatcccggtgaaactcgtgatgctgtcaaagcttcccaaactcctggaccagttgtggacctgaaagtgaggtctgtatctaagtcatcctgtagcattggctggaaaaagcctcacagtgatggtggaagtcggattattggatatgtagttgatttcctgactgaagaaaataagtggcaacgagttatgaaatccttaagcctacagtactctgcaaaagatttgactgaagggaaggaatataccttcagagtgagtgctgagaatgaaaatggagaaggaaccccaagcgaaatcactgttgtggcaagggatgatgttgtggctcctgatcttgacttaaagggtctacctgatttgtgctacttggctaaagaaaacagcaacttccggcttaagatccccataaaaggcaagccagctccatcagtctcctggaagaaaggggaagatcctctagcaactgacactagagtcagtgttgagtcatctgcggttaacacaactcttatagtgtacgattgccaaaaatctgatgctggaaaatacacaatcacacttaagaatgttgctggcaccaaggaaggaactatctccataaaggttgttggcaagcctggcatccccactggaccaatcaaatttgatgaagtcacagcagaagccatgaccttaaagtgggctcctccaaaggatgatggaggttctgaaatcaccaactatatcctagagaagagggattctgtgaacaacaagtgggtgacgtgcgcctcagctgtccagaaaaccacctttagagtaaccagacttcatgagggcatggaatataccttcagggtcagtgccgaaaataaatatggtgtaggggaaggcctgaaatcggagccaattgttgcgagacatccatttgatgtgcctgatgctcccccacctcccaatattgtggatgtcagacacgattcagtatctctaacttggactgaccccaagaaaactggtggttctccaattacagggtatcatctcgagttcaaggaaagaaacagccttttgtggaagagagctaacaagactccgataaggatgagagactttaaagtgacaggattaactgaaggtcttgaatatgaattccgagttatggcaatcaatttagcaggtgtgggcaagccaagcctaccatcagagcctgttgtggcactggacccaattgatcctcctggaaaacctgaggttattaacataacaaggaattcagtgactctcatttggactgaacctaaatatgacggtggtcataagttaactggatatatagtggagaagcgagatctaccttcgaagtcttggatgaaagccaaccatgttaatgtcccagaatgtgcctttactgtaactgaccttgttgagggtggaaaatatgaattcagaattagagcaaagaatacagcaggtgctatcagtgctccatcagaaagtacagaaaccattatttgcaaggatgaatacgaggcaccaacaattgtccttgatcccacaataaaagatgggctaacaattaaagcaggggataccattgttttgaatgccattagcattcttggcaaaccccttccaaaatcaagttggtccaaggcaggaaaagacattagaccatcagatatcactcagataacttcaaccccaacatcttccatgcttactatcaagtatgccactagaaaagatgcgggtgaatataccatcactgctaccaatccttttggcacgaaggtggaacatgtgaaggtaacagtccttgatgtacctggtcccccaggtcctgttgaaatcagtaatgtttctgctgaaaaagcaacacttacatggacacctcccttggaagatggcggctcaccaattaagtcctatatacttgaaaagagagaaaccagccgacttttgtggacagtggtttctgaagatattcagtcttgcaggcatgtggcaaccaaacttatccaaggaaatgagtacatcttccgggtctcagctgtaaaccactatggcaaaggagaacctgtacagtctgaacctgtcaaaatggtagacagatttggtccccctggccctcctgaaaaaccagaggtatcaaatgtcactaagaacactgccactgtcagctggaaaaggccagtggatgatggtggcagcgaaattacaggatatcatgtagaaaggagagaaaagaaaagcctgcgatgggtgagagcaataaaaacaccagtttccgatctcaggtgcaaagtaacaggactgcaagaaggaagcacctacgaattccgtgtcagtgcagaaaacagagcaggaattggtccacccagtgaggcttcagattctgttctgatgaaagatgcagcatatcctccaggaccaccttcaaatccgcatgtcactgatactaccaagaaatctgcttctttggcatggggcaagcctcattatgatggtggacttgaaatcactggctatgtcgtggagcatcaaaaagtaggagacgaggcctggataaaagataccacaggaaccgccctcagaatcactcagttcgttgttcctgatcttcagactaaagaaaaatacaacttcagaatcagtgccatcaacgatgcaggtgttggggagccagcggtgattccagatgttgaaatcgtagaacgggagatggctcctgattttgaactagatgccgagcttcgaagaacacttgttgttagagcaggactcagtattaggatatttgtgccaattaaaggtcgtcctgctcctgaagtgacatggaccaaagataacatcaacctgaaaaaccgagccaacattgaaaatacggaatcatttactcttctgattatcccagaatgtaacagatatgataccggtaaatttgtcatgaccattgaaaacccggctgggaagaaaagtggctttgtgaacgtcagagtcttggacacgccaggcccagtcctcaacctgcggcctacagacatcacaaaggacagtgtcaccctgcactgggacctccctctgatagatggaggctcacgtataacaaactacattgtagagaaacgtgaagcaacacggaaatcttattccacagccaccactaagtgccataaatgcacatataaagttaccggcttgtctgaagggtgtgaatatttcttcagagtgatggcagagaatgaatatggaattggtgagccaacagaaactacagagcccgtaaaagcctctgaagcaccatctccaccagacagccttaacatcatggacataactaagagcaccgtcagcctggcatggcctaagcccaaacacgatggtggcagcaagatcactggctatgtgattgaagcccaaagaaaaggctctgaccagtggacccacatcacaaccgtgaaagggttagaatgtgttgtgaggaatctaactgaaggagaggaatataccttccaagtgatggcagtgaacagcgcggggagaagtgcccctagagaaagcagacccgtcattgtcaaggagcagacaatgcttccagagctggatctccgtggcatctatcagaaactggtcattgccaaagctggtgacaacatcaaagttgaaattccagtgctcggtcgaccgaagcccacagtgacatggaaaaaaggagaccaaattcttaaacagacacagagagttaattttgaaaccacagcgacttcaaccattttaaatatcaatgagtgtgtcagaagtgatagtgggccctatccattaacagcaaggaacattgtaggagaggttggtgatgtcatcaccattcaagtccatgatatcccagggccacctactggaccaatcaaatttgatgaagtttcatctgattttgtaaccttctcttgggacccacctgagaacgatggtggtgtaccaataagcaactatgtagtggaaatgcggcagactgacagtactacctgggttgagttagcaaccaccgttatacgtactacctataaagccacccgccttactactggattagagtatcagttccgtgtaaaagctcagaatagatatggagttggaccaggcatcacatcagcatgcatagttgccaactatccatttaaggttcctggacctcctggtacccctcaggtaactgcagttaccaaggattcaatgacaattagctggcatgagccactttctgatggtggaagccccattttaggatatcatgttgaaagaaaagaacgaaatggtattctctggcagactgtgagcaaagctttagtaccaggcaacattttcaaatcaagtggacttacagatggtattgcttatgagttccgggtgattgcagaaaacatggcaggcaaaagtaagccaagcaagccatcagaacctatgttggctctggatcccattgacccacctggaaaaccagtacctctaaatattacaagacacacagtaacacttaaatgggctaagcctgaatatactgggggctttaaaattaccagttatatcgttgaaaagagagaccttcctaatggacggtggctgaaggccaacttcagcaacattttggagaatgaatttacagtcagtggcctaacagaagatgctgcatatgaattccgtgtgatcgccaaaaatgctgcaggtgccatcagtccaccatctgagccatctgatgctatcacttgcagggatgatgttgaggcaccaaagataaaggtggatgttaaatttaaggacacggttatattaaaagcaggtgaagcattcagactggaagctgatgtttcaggccgcccacctccaacaatggaatggagcaaagatggaaaagagctggaaggcacagcaaagttagaaataaaaattgcagatttctctactaatctggtaaacaaagattcaacaagaagggatagtggtgcctatacccttacagcgactaatcctggtggctttgctaaacacattttcaatgtcaaagttcttgacagaccaggcccacctgaaggacctttggctgtaactgaagtgacatcagaaaagtgtgtactatcatggttccctccactggatgatggaggtgccaaaattgatcattacatagtacagaaacgtgaaaccagcagattggcatggacaaatgtagcctcagaagtccaagtaacaaagctaaaggtcactaaactcttgaaaggcaatgaatacatattccgtgtcatggctgtaaataaatatggagtgggagagccactggaatcagagcctgtgcttgcagtgaatccttatggaccccctgatccgcccaaaaaccctgaagtgacaactattactaaagattcgatggttgtctgctggggacatcctgattctgatggtggaagtgaaatcatcaattatattgtggaacggcgtgataaagctggccaacgctggattaaatgcaacaaaaaaactcttactgatttaagatataaagtgtctggactgacagaaggacatgaatatgagttcaggattatggctgaaaatgctgctggaattagtgcaccaagtcctaccagtccattttacaaggcttgtgacactgtgtttaaacctggaccaccaggtaacccacgtgttctggatacaagcagatcatccatttcaatcgcttggaataaacctatctatgatggtggttcagaaatcactgggtatatggttgagattgccctgccagaggaagatgaatggcagattgtcactccaccagcaggactcaaggcaacttcgtatactatcactggcctcacagagaatcaggaatataagatccgcatctatgccatgaattccgaaggacttggggaacctgcccttgttcctggaactccaaaggctgaagacagaatgctgcctccagaaattgaactggatgctgacctgcgcaaagttgttactataagggcctgctgcaccctgagactttttgttcccatcaaaggaaggcctgcacctgaggtgaagtgggcccgggaccatggagaatctttagataaagctagcatcgaatccacaagctcttacaccctgcttattgttggaaatgtaaacagatttgacagtggcaaatatatactaactgtagaaaatagttcaggcagcaagtctgcatttgtcaatgttagagttctcgatacaccaggccccccacaggatctgaaggtaaaagaggtcactaagacatctgtcacactcacatgggacccacctctccttgatggaggttcaaaaatcaagaactatattgttgaaaagcgggaatcaacaagaaaagcatattcaactgttgcaacaaactgccacaagacttcctggaaggtagaccagcttcaagaaggctgtagctactatttcagggttctcgcagaaaatgaatatggcattgggctgcctgctgaaaccgcagaatctgtgaaagcatcagaacgacctcttcctccaggaaaaataactttgatggatgtcacaagaaatagtgtgtcactctcttgggagaaaccagagcatgatggaggcagccgaattctaggctacattgtggagatgcagaccaaaggcagtgacaaatgggccacgtgtgccacagtcaaggtcactgaagccactatcactggattaattcagggtgaagaatactctttccgtgtttcagctcagaatgaaaagggcatcagtgatcctagacaactgagtgtgccagtgatcgccaaagatcttgtcattccaccagccttcaaactcctgttcaatactttcactgtactggcaggtgaagacctaaaagttgatgttccattcattggccgccctaccccagctgtaacctggcataaagataatgtaccactgaagcagacaactagagtaaatgcagagagcacagaaaataattcactactgacaataaaggacgcctgccgagaagatgttggccattatgtggttaaactgactaactcagctggtgaagctattgaaacccttaatgttatcgttcttgacaaaccagggcctccaactggaccagttaaaatggatgaagtgacagctgatagtattactctttcctggggcccacccaagtatgatggtggaagttctatcaataattacattgttgagaaacgggacacttccacaaccacctggcaaattgtatcagctacagttgcaaggacaacaataaaggcttgcagactgaagactggatgtgaatatcagtttagaattgcagctgaaaacagatatgggaagagtacctacctcaattcagagcctactgtagcccaatatccattcaaagttcctggtcctcctggcactccagttgtcacactgtcctccagggacagcatggaagtacaatggaatgagccaatcagtgatggaggaagtagagtcattggctatcatctagaacgcaaggaaagaaatagcatcctctgggttaagttgaataaaacacctattcctcaaaccaagtttaagacaactggccttgaagaaggtgttgaatatgaatttagagtctctgcagagaacatcgtgggcattggcaagccgagtaaagtatcagaatgttatgtggctcgtgacccatgtgatccaccaggacggccagaggcaatcattgtcacaaggaattctgtgactcttcagtggaagaaacccacctatgacggtggaagcaagatcactggttatattgttgagaagaaagaattacctgagggccgttggatgaaagccagttttacaaatattattgacactcattttgaagtaactggcctagttgaagatcacagatatgagttccgggttatagcccgaaatgccgcaggagtgtttagtgagccttcagaaagcacaggagcaataacagctagagatgaggtagatccaccacgaataagtatggatccaaaatacaaagacacaatcgtggttcatgctggtgaatcattcaaggttgatgcagatatttatggcaaaccaataccaaccattcagtggataaaaggtgatcaggagctttcaaacacagctcgattagaaataaagagcaccgactttgccaccagtctcagtgtaaaagatgcagtacgtgtcgacagtggaaattacatactgaaggccaaaaatgttgcaggagaaagatcagttactgtgaatgtcaaggttcttgacagaccagggccacctgaaggacctgttgttatctcaggagttacagcagaaaaatgcacactagcttggaaacccccacttcaggatggtgggagtgacatcataaattatattgtggaaaggagagaaaccagccgcttagtttggactgtggttgatgccaatgtgcagactctcagctgcaaggttactaagcttcttgaaggcaatgaatatactttccgtataatggcagtaaacaaatatggtgttggtgaacctcttgaatctgagccagtagttgccaagaatccatttgtagtaccagatgcaccaaaagctccagaagtcacaacagtgaccaaggactcaatgattgttgtatgggaaagaccagcatctgatggtggtagtgaaattcttggatatgttcttgagaaacgggataaagaaggcattagatggacaagatgccataagcgtctgattggagagttgcgcctgagagtaactggactcatagaaaatcacgattatgagttcagagtttctgctgagaatgctgctggacttagtgaaccaagccctccttctgcttaccaaaaggcttgtgatcctatttataaaccaggacccccaaacaaccccaaagtcatagacataaccagatcttcagtattcctttcttggagcaaaccaatatatgatggtggctgtgaaattcaaggatacattgttgaaaaatgtgatgtgagtgttggtgaatggacaatgtgcactccaccaacaggaattaataaaacaaacatagaagtagagaagctgttggaaaagcatgaatacaacttccgtatctgtgctattaataaagctggagttggagaacatgctgacgtccctggacctattatagttgaagaaaaattagaagcaccagacattgatcttgacctagaactaaggaaaatcataaatataagggcaggtggctccttaaggttatttgttcctataaaaggtcgtcctacaccagaagttaaatggggaaaggtggatggtgaaatccgagatgcagctataattgatgtcactagcagtttcacctctcttgttcttgacaatgtcaaccgatatgatagtggaaaatatacgcttacattagaaaacagcagtggaacaaagtctgcctttgttactgtgagagttctggacacgccaagtccacctgttaacctgaaagtcacagaaatcaccaaagactcagtatcaattacatgggaacctcctttgttggatgggggatccaaaataaaaaattacattgttgagaaacgtgaagccacaagaaaatcatatgctgctgttgtaactaactgccataagaattcttggaaaatcgatcagctccaagaaggttgcagttattactttagagtcacagctgagaatgagtatggtattggccttcctgcccagactgctgatccaattaaggttgcagaagtgccacaacctcctggaaaaataactgtggatgatgtcaccagaaacagtgtctctctgagttggacaaaacctgaacatgatggtggcagtaaaatcattcagtatattgtggaaatgcaagctaaacacagtgagaaatggtcagagtgtgctcgagtaaagtctcttcaggcagtaattaccaacctaactcaaggggaagaatatctttttagagttgttgctgtaaatgaaaaggggagaagtgatcctcggtcccttgcagttccaatagttgccaaagatctggtaattgagccagatgtaaaacctgcattcagtagttacagtgtacaggttggccaagatttgaaaatagaagtgccaatttctggacgtcctaagccaaccattacctggactaaagatggtctcccactgaagcagaccacaagaatcaatgttaccgattcactggatctcaccacactcagtattaaagaaactcataaggatgatggtggacaatatggaatcacagttgccaatgttgttggtcagaagacagcatccatcgaaattgtaactctagataaacctgatcctccaaaaggacctgttaaatttgatgacgtcagtgctgaaagtattacattatcttggaaccctccattatatacagggggctgccaaatcaccaactacattgttcagaaaagagatacaaccaccacagtatgggatgttgtttctgctactgttgctagaactacactcaaagtgaccaaactgaaaactggtacagaataccaatttagaatatttgccgaaaacagatatggacaaagctttgccttagagtctgatccaattgtagctcaatatccctacaaagaaccaggccctccaggtacaccatttgccacagccatttccaaagactccatggtcatacagtggcatgaaccagtcaacaatggtggaagccccgtcataggttaccacctggagagaaaagaaagaaacagtattttgtggacaaaggtcaacaaaactattattcatgacacccaattcaaagcacagaatcttgaagaaggcattgaatatgaattcagagtgtatgctgaaaatattgttggtgtaggcaaagcaagcaagaattctgaatgctatgtagccagagatccctgtgacccaccaggaaccccagaaccaataatggttaaaagaaatgaaatcactttacagtggaccaaacctgtgtatgatggtggaagtatgattacaggctacattgtagagaaacgtgatttgcctgatggtcgttggatgaaagctagctttacaaatgtcattgaaactcaatttactgtgtcaggtcttactgaagatcaaagatatgaattcagagtcattgcaaagaatgcagctggtgcaataagtaaaccctctgacagtactggaccaataactgccaaggatgaggttgaactcccaagaatttcaatggatccaaaattcagagacacaattgtggtaaatgctggagaaacattcagacttgaggctgatgtccatggaaagcccctacctaccattgagtggttaagaggagataaggaaattgaagaatctgctagatgtgaaataaagaacacagatttcaaggctttacttattgtaaaagatgcaattagaattgatggtgggcagtatattttaagagcttccaatgttgcaggttctaagtcattcccagtaaatgtaaaagtattagatagaccaggacctccagaagggccagtccaggttactggagtcacttctgaaaaatgctctttaacatggtctccaccacttcaagatggtggcagtgacatttctcactatgttgttgaaaagcgagaaaccagtcgacttgcctggactgttgttgcttcagaagttgtgaccaattctctgaaagttaccaaactcttagaaggtaatgaatatgttttccgtataatggctgtcaacaaatatggtgttggagagcctttggaatctgcaccagtactaatgaaaaatccatttgtgcttcctggaccaccaaaaagcttggaagtcacaaatattgccaaagactccatgaccgtctgttggaaccgtccagatagtgatggtggaagtgagattattggttacattgtagagaaaagagacagaagtggcattcgatggataaaatgtaataaacgccgcattacagatttgcgtctaagagtgacaggattaacagaagatcatgagtatgaattcagggtctctgcagaaaatgctgctggagttggggaaccaagtccagctacagtttattataaagcctgtgatcctgtgttcaaacctggcccacctaccaatgcacacattgtagacaccactaaaaattcaatcacacttgcctggggtaaacccatctatgatggcggcagtgagatcttgggatatgtagtagaaatctgtaaagcagatgaagaagaatggcaaatagttactccacagactggcctgagagtcactcgatttgaaatttcaaaactcactgaacaccaagagtataaaatacgagtctgtgccctcaacaaagttggtttaggtgaggctacatcagttcctggtactgtgaaaccagaagataaacttgaagcacctgaacttgaccttgactccgaattaagaaaaggaattgttgtaagagctggtggatctgccagaattcacattccattcaaaggtcgtccaacgcctgagatcacttggtctcgagaggaaggtgaattcacagataaggtccaaattgaaaagggagtaaactatacccaactatcaatagataactgtgatagaaatgatgctggaaaatacattcttaagttggaaaacagcagtggatcaaagtctgcttttgtaactgtgaaagttcttgacactccaggaccaccacagaatttggcagtcaaagaagtgagaaaagattctgccttcctggtatgggagccacccatcattgatggaggggcaaaggtcaagaactatgtgattgacaaacgtgagtcaaccagaaaagcgtatgctaatgtgagtagtaaatgcagcaaaacaagttttaaagtggaaaaccttacagaaggagccatttattacttcagagtcatggctgaaaatgaatttggagttggtgttccagtggaaactgttgatgccgtgaaagctgctgaacctccttccccaccaggaaaggttacactcactgatgtgtcccagaccagtgcatcacttatgtgggagaaacctgaacatgatggcggtagcagagtcctggggtacgttgttgaaatgcagcccaaaggaactgaaaaatggagcattgtggctgaatccaaagtctgtaatgcagttgttactggtttgagttctggacaagaatatcagttccgtgtcaaggcttataatgagaaaggaaaaagcgatccaagagtgttgggtgttcctgtcatagccaaggacttgactatacagcctagtttaaagttaccatttaacacatatagtatccaagctggagaagatcttaaaatagaaattccagttataggccgaccaagacctaacatttcttgggtcaaagatggtgagcctcttaaacagacaacaagagtaaacgttgaagaaacagctacctcaactgttttgcacattaaagaaggtaacaaagatgactttggaaaatacaccgtaacggcaacaaatagtgcaggcacagcaacagaaaatctcagtgttatcgttttagaaaagcctggacctccagttggcccagttcggtttgatgaagttagtgcagactttgtagtcatatcttgggaacctccagcctatactggtggctgccaaataagcaactacattgtagagaagcgagatacaaccaccaccacttggcacatggtatcagcaacagttgcaagaacaacaattaaaataaccaaactgaaaacaggcacggagtaccagtttagaatttttgctgaaaacaggtatggaaaaagtgccccactggattctaaggcagttattgtacaatatccatttaaagaacctggaccacctggaactccttttgtgacatcaatctcaaaagatcagatgcttgtgcaatggcatgagccagtgaatgatggaggcaccaaaattattggctaccatcttgaacagaaagaaaagaacagtattttatgggtcaagttaaataagacccccattcaggacaccaaattcaaaacaactgggcttgatgagggccttgagtatgagttcaaagtttctgctgaaaatattgttggcattggcaagcctagcaaagtgtcagaatgctttgttgctcgtgatccatgtgacccacctggtcgccctgaagccattgttattacaagaaacaatgtcacactgaaatggaagaaacctgcctatgatggtggtagcaaaataacaggttatattgtagaaaagaaagatctacctgatggccgctggatgaaagccagctttaccaacgtattagaaactgaatttacagtgagtggacttgtagaagaccaaagatatgaatttagagtaattgcaagaaatgcagctggaaactttagtgaaccatctgatagtagtggtgccattactgcaagagatgaaattgatgcaccaaatgcctctctggatccaaaatataaagatgtcatcgttgttcatgcaggagagacttttgttcttgaagccgacatccgtggcaaacctatacctgatgttgtttggtcaaaagatggaaaagaacttgaagaaacagctgctagaatggaaattaaatctactattcagaaaacaactcttgttgtcaaagactgtatacggactgatggaggacaatatattctgaaactcagcaatgttggtggtacaaagtctatacccatcactgtaaaggtacttgacaggccagggcctcctgaagggcctctgaaagttactggagttactgcggaaaaatgttacctggcatggaacccacctttgcaagatggtggtgctaatatttcacattacatcattgaaaagagggagacaagccgactctcttggacccaggtttcaactgaggtacaggcccttaactacaaagttactaaacttcttcctggtaatgagtacattttccgtgtcatggctgtgaataaatatggaattggagagcccttggaatctgggcctgttacggcctgtaatccttataagccaccaggtcctccctcaacacctgaagtctcagcaatcaccaaagattctatggtagtaacatgggcacgcccagtagacgacggaggtaccgaaattgagggctacattcttgaaaaacgagataaggaaggcgttagatggaccaagtgcaacaagaaaacattaacggatctgcggctcagggtaactggtcttaccgaaggccattcctatgaattcagagttgctgctgaaaatgcagctggtgtgggagaacctagtgagccatctgttttctaccgtgcgtgtgatgccttgtatccaccaggtcccccaagcaatccaaaagtgacggacacttccagatcttctgtctccctggcatggagtaagccaatttatgatggtggcgcacctgttaaaggctatgttgtagaggtcaaagaagctgctgcggatgaatggacaacctgcactccaccaacaggattacaaggaaagcagttcacagtgaccaagcttaaagaaaacactgaatataacttccgtatttgtgccatcaattctgaaggtgtaggtgaacctgcaactctacctggctcagtggttgctcaggagaggatagagccaccagaaatagaactcgatgctgatctcagaaaggtggtcgttctgcgtgcaagtgctactttacgcttatttgtcactatcaaaggtcgaccagaacccgaagttaaatgggaaaaggcagaaggcattctcactgacagggctcagatagaggtgaccagctcatttacaatgttggtgattgataatgttaccagatttgacagtggtcggtataatctgacattagaaaataatagtggctccaaaacagcttttgttaacgtcagagttcttgactcaccaagtgcccctgtgaatttgaccataagagaagtgaagaaagactcagtgacgttgtcctgggaaccaccacttattgatggtggagctaagattacaaactacattgtcgaaaaacgagaaactacaagaaaagcctatgctaccattacaaataattgcactaaaactactttcagaattgaaaatctacaagaaggatgttcttactacttccgagtcttggcttccaatgaatatgggattggtttgccagctgaaacaacagaacccgttaaagtgtctgaaccacccctcccacctggaagagtaactcttgttgatgtgacccgtaatacagctacaattaagtgggagaaaccagaaagtgatggtggcagcaaaattactggttatgtggttgaaatgcagactaaagggagtgaaaagtggagcacctgcacacaagttaagactctagaagcaactatatctggcttaactgcaggagaagagtatgtcttcagggtagctgcagttaacgaaaagggaagaagtgatccaagacaacttggagtgccagtaattgcaagggatattgaaataaagccttcagttgagcttcctttccatactttcaatgtaaaggctagagaacaacttaagattgatgtgccattcaaaggaagacctcaagctactgtgaactggagaaaagatggtcagactcttaaagagacaactagagtcaatgtttcttcttcaaagactgtaacatcactatctattaaggaagcttcaaaggaagatgttggaacttatgaattatgtgtttcaaacagtgctggatccataacagttcctattactataattgtccttgacagaccaggacctccaggtcctatacgtattgatgaggttagttgtgacagcataaccatttcttggaatcctccagaatatgatggtggctgccaaattagcaattacattgttgaaaagaaagaaaccacctctacaacatggcacatagtttcacaagcagttgcaagaacatccattaaaatagttcgcctgacaacaggaagtgagtatcagttccgtgtttgtgcagaaaaccgctatggaaagagctcctacagtgaatcttcagctgttgttgcagagtatccattcagtcccccaggtcctcctggtactcctaaagttgtgcatgccacaaaatctaccatgcttgtaacctggcaagtgccagttaatgatggaggaagtcgagtaattggctatcatcttgagtataaagaaagaagcagcattctttggtcaaaagcaaataaaatcctcattgctgatactcaaatgaaagtctccggccttgatgaaggactgatgtatgagtatcgtgtatatgctgaaaatattgctggaattggtaaatgcagtaaatcttgtgaaccagtccctgcaagagatccttgtgaccctcctggacaacctgaagtcacaaatatcacaagaaaatcagtgtcacttaaatggtctaaaccacattatgatggtggagctaagatcacaggatacattgttgaacgcagagaactaccagatggccggtggctgaagtgcaattatactaatatacaagaaacatactttgaagtaactgaacttactgaagatcagcgttatgaattccgggtttttgcaaggaatgctgctgactcagttagtgagccatctgaatccactgggcctattatagttaaagatgatgttgagcctccaagagttatgatggatgtcaagttccgagacgttattgttgtcaaagctggagaggtccttaagataaatgcagacattgcagggcgacctctgccagtaatttcctgggccaaggatggtatagaaattgaagaaagagcaagaacagaaatcatctcaacagacaatcatactttgttaacagttaaagactgtataagacgagacactgggcaatatgtactaacactgaagaatgttgccggcactcggtctgtggccgttaattgcaaagtacttgataagcctggtccaccagcaggaccacttgaaataaatggcctcactgctgagaaatgctctctttcctggggacgtccccaagaagatggtggtgcagatatcgactattacatcgtagaaaaacgtgaaacaagccaccttgcatggacaatatgtgaaggagagttacagatgacatcctgtaaagtaaccaagttactcaaaggcaatgaatatatatttagagtaactggtgttaataaatatggtgttggtgagcccctagagagtgtagctataaaggcactagatccatttacagttccaagtccacccacgtctttggaaattacttctgtgaccaaagaatctatgacactttgctggtcaagacccgagagtgatggaggtagtgaaatatctggatatataattgaaaggcgagagaaaaatagcctaagatgggtgcgtgtaaacaaaaaaccagtttatgatctaagagtgaaatcaacaggacttcgggaaggatgtgaatatgaatatcgtgtttatgcagaaaatgctgctggcctaagtcttccaagtgaaacctctcccttaattagggcagaagatccagtgttcctaccatctcctccatccaaacccaaaattgtggactcaggcaagacaactataactattgcctgggttaagccgctgtttgatggtggggccccgataactggatatactgtagaatacaaaaaatctgatgacactgactggaaaacttccattcagagcttacgagggacagaatatacaataagcggactaacaacaggagctgaatatgttttcagagtaaaatctgtcaataaggttggtgctagtgaccccagtgatagctctgaccctcagatagcaaaggaaagagaagaagaacctttatttgatattgacagtgaaatgaggaagaccttgattgtcaaggctggtgcctcatttaccatgactgtgcctttccgaggaagaccagtacccaatgtcttgtggagtaagccagacactgacctccgtactagagcttatgttgataccacagactcccgtacatcactgaccattgaaaatgccaacagaaatgactctggaaagtacacattaacaattcagaatgttttgagtgctgcttcactgaccttagttgtcaaagttttagataccccaggtcctccaaccaacattactgtgcaagatgtaaccaaagagtctgcagtgttatcctgggatgttcctgaaaacgatggtggagcaccagtgaagaattaccacatagaaaaacgtgaggccagcaagaaagcatgggtctctgtgaccaacaactgtaaccgcctctcctacaaagttaccaatttacaagaaggagctatctattacttcagagtctctggagaaaatgagtttggtgttggtataccagctgaaacaaaggaaggagtaaaaataacagaaaaaccaagcccacctgaaaaacttggagtaacaagtatatccaaagacagtgtttccctgacctggctgaagcctgaacatgatggcggaagcagaattgtacactatgtcgttgaagcactagaaaaaggacagaaaaactgggttaaatgtgcagtggcaaagtcaacccatcacgttgtttccggtctgagagagaattctgaatactttttccgagtgtttgctgaaaatcaagctggcctgagtgacccgagagagcttctgcttcctgttcttattaaggagcaactagaaccacctgaaattgatatgaagaatttcccaagtcacactgtatatgttagagctggttcaaaccttaaagttgacattccaatctctggaaaaccacttcccaaagtgaccttatcaagagatggtgtcccccttaaggcaaccatgagatttaataccgaaattactgctgagaacctgaccatcaatctcaaagaaagtgttacagctgacgctgggagatatgaaatcactgctgccaactccagtggtacaaccaaagctttcattaacattgttgtgctagacaggcctggtcctccaactggccctgttgttattagtgatataactgaagaaagtgtgactctcaaatgggagccacctaagtatgacggtggaagtcaagttaccaactacattctactcaaaagagaaacaagtactgcagtgtggactgaagtgtctgcaacagttgcaagaaccatgatgaaagtcatgaaactgaccacaggagaagaataccaattccgcatcaaggcagaaaaccgctttggcatcagtgatcatatagattcagcttgtgtgactgtcaaactaccatacacaacacctggaccaccatctacaccatgggtcactaatgttactcgagaaagcatcactgtgggctggcatgaaccagtgtcaaatggaggcagtgcagtcgtaggctatcacctggaaatgaaagacagaaacagtattttatggcaaaaagccaacaaactggtcatccgcacaactcacttcaaagtcacaacaatcagtgctggacttatttatgaattcagggtgtatgcagaaaatgctgctggagttggaaaacctagccatccttctgaaccagtcttggcaattgatgcttgtgaacccccaagaaatgttcgtatcactgatatttcaaagaactctgtcagcctttcatggcaacaaccagctttcgatggaggtagcaagattacaggctacattgttgagagacgtgaccttccagatggcagatggaccaaggccagcttcaccaatgttactgaaactcaattcatcatctctggcttgactcagaattcccagtatgaattccgtgtctttgctaggaatgctgttggttccattagcaatccatctgaggttgtagggcccattacttgcatcgattcttatggtggtcctgtaattgatttgcctctagaatatacagaagttgtcaaatacagagcaggtacatctgtgaagctcagagctggcatttctggcaaacctgcgcctactattgagtggtataaagatgataaagaattacaaaccaatgcactggtgtgtgttgaaaataccacggacctcgcatctatactcatcaaagatgccgatcgccttaatagtggatgctatgaattaaaactaaggaatgccatgggctcagcctcagccaccatcagagtacagatccttgacaaaccaggcccacctggtggaccaattgaatttaagactgtaactgctgagaagatcacccttctctggcggcctccagctgatgatggtggtgcaaaaatcactcactacattgtggaaaagcgtgagacaagccgcgttgtgtggtctatggtgtctgaacatttggaagagtgcatcattacaaccaccaaaattatcaaaggaaatgaatacatcttccgggtccgagccgtgaacaaatatggaattggcgagccactggaatctgattccgttgtagccaagaacgcatttgttacacctgggccaccaggcataccagaagtgacaaagattaccaagaattcgatgactgttgtatggagcaggccaattgcagatggcggtagtgatataagtggctatttccttgaaaaacgagacaagaagagcctaggatggtttaaagtactaaaagagactatccgtgacaccagacaaaaagtaacaggactcacagaaaacagtgactatcaatacagagtttgtgctgtaaacgctgctggacagggtccattttctgaaccatctgaattctacaaagctgctgatcctattgatcctccaggtccacctgctaagataagaatcgcagattcaaccaagtcatccatcacccttggctggagtaagcctgtctatgatgggggcagtgctgttactgggtatgttgtcgagataagacaaggagaggaagaggaatggactactgtctctaccaaaggagaggtcagaactacagaatatgtggtatccaacctgaaacctggagtcaattactacttccgggtatctgctgtaaactgtgctggacaaggagaacctatagaaatgaatgaacctgtacaagctaaagatatacttgaggcaccagagattgacctggatgtggctctcagaacttctgttattgccaaagctggtgaagatgtacaagtgttgattccctttaaaggcagacctccacctactgtcacatggagaaaagatgagaagaatcttggcagtgatgccagatacagcattgaaaacactgattcatcctcattactcaccattcctcaagttactcgcaatgatacaggaaaatatattctcacaatagaaaatggagttggtgaacctaagtcttcaactgtgagtgttaaagtgcttgacacaccagctgcctgccagaaactacaggttaaacatgtttctcgaggcacagtcactttgctctgggatcctcctctcattgatggaggatctccaataattaattatgtcattgaaaagagagatgccaccaagagaacatggtctgtcgtgtcacacaaatgttctagcacatccttcaagctaatagatttgtcggagaagactccattcttcttcagagttcttgcagaaaatgaaattggaattggggaaccctgtgaaactacagagccagtgaaggctgctgaagtaccagctcctatacgtgatctctcaatgaaagactcaacaaagacatctgtcatcctcagctggaccaaacctgactttgatggtggtagcgtcatcacagaatatgttgtagaaaggaaaggtaaaggtgaacagacgtggtcccacgctggcataagtaagacatgtgaaattgaggttagccaacttaaggagcagtcagtcctggagttcagagtgtttgccaaaaatgagaaaggactgagtgatcctgtcactattgggccaattacagtgaaagaacttattattacacctgaagttgacctgtcagatatccctggggcacaagtcactgtgagaattgggcacaatgtgcaccttgaattaccttataagggaaaacccaaaccatccatcagttggctgaaagatggcttgccactgaaagaaagtgaatttgttcgcttcagtaaaactgaaaacaaaattactttgagtattaagaatgccaagaaggagcatggaggaaaatacactgttattcttgataatgcagtgtgtagaattgcagtccccattacagtcatcacccttggcccaccatcaaagcccaaaggacccattcgatttgatgaaatcaaggctgatagtgtcatcctgtcatgggatgtacctgaagataatggaggaggagaaattacttgttacagcatcgagaagcgggaaacttcacaaactaactggaggatggtgtgttcaagtgttgccagaacgactttcaaagttcctaatctagtcaaagatgctgagtaccagtttagagtgagagcagaaaacagatacggagtcagccaaccacttgtctcaagcattattgtggcaaaacaccagttcaggattcctggtcccccaggaaagccagttatatacaatgtgacttctgatggcatgtcactaacttgggatgctccagtttatgatggtggttcagaagttactggattccatgttgaaaagaaagaaagaaatagcatcctctggcaaaaagttaatacatcaccaatctctggaagagaatatagagccactggactggtagaaggtctggattaccaattccgtgtatatgctgaaaattctgctggcctaagctcacctagtgacccaagcaaatttaccttagctgtttctccagtagacccacctggcactcctgactacattgatgtcacccgggaaaccatcacacttaaatggaacccaccattgcgtgatggaggcagtaagattgtgggctatagcattgagaaacggcaaggaaatgaacgctgggtgagatgcaactttactgacgtcagtgaatgtcagtacacagttacaggactcagtcctggggatcgctatgagttcagaataattgcaagaaatgctgttggaactataagcccgccctcacagtcttctggcattattatgacaagagatgaaaatgttccaccaatagtagagtttggccctgaatactttgatggtctcattattaagtccggagagagccttagaattaaagctttggtacaaggaagaccagtgcctcgagtaacttggttcaaagatggagtggaaatcgaaaagaggatgaatatggaaataaccgacgtacttggatccaccagcctatttgttagagatgctactcgggaccatcgtggtgtatacacagtggaagccaaaaatgcatctggttctgcaaaagcagaaattaaagtgaaagtacaagatacaccaggaaaagtagttgggccaataagattcaccaatattactggggagaagatgactctgtggtgggatgccccactcaatgacggttgtgctcccataacccactacatcattgaaaaacgggaaaccagcagacttgcctgggcactaattgaggataaatgtgaagcccaaagttacactgccattaaactaataaacggcaatgaataccaattccgtgtttctgcagttaacaagtttggtgttggcaggccacttgattctgatccagtggttgctcaaatacaatatactgttcctgatgcccctggcattccagaacctagcaacataacaggcaacagcattaccctgacatgggcaaggccagaatcagatggtggcagtgaaattcaacagtatatccttgaaagaagagaaaagaaaagcacaagatgggtaaaagtgatcagcaaacgaccaatctctgaaacaagattcaaagtcactggtctgacagaaggcaatgagtatgaattccatgtcatggctgaaaatgctgcaggagttggacctgcaagtggcatctcaagactcattaaatgtagagagcccgtcaacccaccaggtcctcccacagtggtcaaagtaacagacacatcaaagacaactgtgagcttagaatggtccaaaccagtgtttgatggtggcatggaaataattgggtatattattgaaatgtgtaaggccgacttaggagactggcacaaggtgaatgcagaggcatgtgtgaaaacaagatatacagtcactgatctacaagcaggtgaagaatacaaattccgagttagtgctatcaatggtgctggaaaaggcgacagctgtgaagtgactggcacaattaaagcagttgaccggttaacagctcctgagttagacatagatgcaaacttcaaacagactcatgttgttagagctggggccagtattcgcctcttcattgcctaccaaggtagacctactcctacagctgtgtggagcaaaccagactctaaccttagccttcgggctgatatccatacaacagattccttcagcaccctcactgtggaaaactgcaacagaaatgatgcagggaaatatacccttactgtggaaaacaacagtggtagtaagtcaatcacattcaccgtgaaagtgctagacactccaggcccacctggcccaattaccttcaaagatgtgacccggggatctgctacattgatgtgggatgcccctcttcttgacggtggtgcccgaatccatcattatgtggtagagaaacgagaggcaagtcgccgtagttggcaggttatcagtgaaaaatgcactcgtcagatcttcaaggtcaatgacctggccgaaggtgttccgtactatttccgtgtttctgcagtaaatgagtatggtgttggtgagccctatgaaatgccagaaccaattgtagccacagaacagcctgctccacctaggagacttgatgttgttgatactagcaaatcctccgcagtcttagcttggcttaaacctgaccacgatggaggcagccggatcactggctacctgcttgaaatgagacaaaagggatctgacttctgggttgaagctggtcacaccaaacagctaactttcacagtagagcgtcttgttgagaaaactgaatatgaattccgtgtgaaggccaagaatgatgctggctatagtgaacccagagaagccttctcttctgtcatcattaaggagcctcaaatcgagcccactgctgacctcactggaattaccaatcagcttataacttgcaaagcaggaagcccatttaccattgacgtaccaatcagtggtcgtcctgcccccaaagtaacatggaaactggaagaaatgagacttaaagagacagatcgagtgagcattacaacaacaaaagacagaaccacactgactgtaaaggacagcatgagaggtgactctggaagatacttcttgaccctggaaaatacagctggtgttaaaacatttagcgtcacagttgtggtcattggaaggccaggtccagtaaccggccccattgaggtctcatctgtctcagctgaatcgtgtgtcctgtcatggggagaacctaaagatggaggaggcactgaaattactaattacatagttgaaaagcgtgaatcgggtacaacagcttggcagcttgtcaattccagtgtcaagcgcactcaaattaaagtcactcatctcacaaaatacatggaatattctttccgtgtcagttcagagaacagatttggtgtcagcaaacctctagaatcagcaccaataattgctgaacatccatttgtcccaccaagcgctcctaccagacctgaggtctaccatgtgtctgccaatgccatgtctattcgttgggaagaaccctaccacgatggtggcagtaaaatcattggctactgggttgagaagaaagaacgtaatacaattctttgggtgaaagaaaacaaagtgccatgcttagagtgcaactacaaagtaactggtttagtagaaggactggaatatcagttcagaacttatgcactcaatgctgcaggtgttagcaaggccagcgaagcttcaagacctataatggctcaaaatccagttgatgcaccaggcagaccagaggtgacagatgtcacaagatcaacagtatcactgatttggtctgccccagcgtatgatggaggcagcaaggttgtgggctacatcatagagcgtaagccagtcagtgaggtaggagatggtcgctggctgaagtgcaactacaccattgtatctgacaatttcttcaccgtgactgctctcagtgaaggagacacttatgagttccgtgtgttagccaagaatgcagcaggcgtaattagcaaagggtctgaatctacaggccctgtcacttgccgagatgaatacgctccacccaaagccgaactggatgcccgattacacggtgatctggttaccatcagagcaggttctgatcttgttctggatgctgcagttggtggcaaacctgaacccaaaattatctggaccaaaggagacaaggagctagatctctgtgaaaaagtctctttgcagtatactggcaaacgagcaactgctgtgatcaagttctgtgacagaagtgacagtggaaaatacactttaacagtgaaaaatgccagcgggaccaaggccgtgtctgtcatggtcaaagtgcttgattcccctggcccatgtggaaagctcaccgtcagcagagtaacacaggagaagtgcactttagcctggagccttccgcaggaagacggaggagcagaaatcactcactacatcgtggaaagacgcgagactagcaggctcaactgggtgattgttgaaggcgaatgcccaaccctatcctatgtcgttaccaggctcatcaagaacaatgagtacatattccgagtgagggcagtaaacaaatatggccctggtgtgcctgttgaatcagagccaattgtagccagaaactcattcactattccatcaccacccggcatacctgaagaagttgggactggcaaagagcatatcatcattcagtggacaaaacctgaatctgatggtggcaatgaaatcagcaactacctagtagacaaacgtgagaagaagagcctgcgctggacacgtgtcaacaaagactatgtggtgtatgataccaggctgaaggtgaccagcctgatggagggttgtgattaccagttccgggtgaccgcagtgaatgcagctggtaacagtgagcccagcgaagcttccaacttcatctcatgcagagaaccatcatatacccctggaccaccttctgctccaagagttgtggataccaccaaacacagcattagtttggcatggaccaaacccatgtacgatggtggtactgacattgtaggatatgttctggaaatgcaagagaaggacactgatcagtggtaccgagtgcataccaatgccacaataagaaatactgaattcactgtgccagaccttaaaatgggccagaaatattccttcagagttgctgccgtgaacgtgaagggtatgagcgaatacagcgaatcaattgctgaaattgagcccgtggaaagaatagaaataccagatcttgagcttgcagatgatctaaagaagactgtgaccatcagggctggggcctccttgcgcttgatggtgtctgtatctggaagaccacctcctgtcataacgtggagcaagcagggcattgaccttgcaagccgggcaattattgacaccactgagagctactcattgctaatagtggacaaagttaatcggtacgatgctggaaaatacacaattgaagctgaaaaccaatctggcaagaaatcagcaacagtccttgttaaagtctatgatactcctggtccctgtccttcagtgaaagttaaggaagtatcaagagattctgtgactataacttgggaaattcccacgattgatggtggagctccagtcaacaattacatcgttgagaagcgtgaagctgctatgagagcattcaaaacagtaactaccaaatgcagcaagacactttacagaatttctggacttgtagaaggaaccatgtactatttcagagtgctgccagaaaatatttatggcattggagaaccttgtgaaacatctgatgcagtactggtctcagaagtgcctttggtgcctgcaaagctagaagtggtcgatgtcaccaaatccactgttacccttgcctgggaaaaaccactctacgatggtggtagccgactcactggatatgttctcgaggcctgcaaagctggcacagagagatggatgaaggttgtcaccttaaaacccacagtcctagagcacactgttacttccttaaatgaaggtgaacaatacttatttagaataagggcacaaaatgagaaaggtgtgtcagaaccaagagagactgtcacagccgtgactgtacaagacctcagagtgttgccaacaatcgatctttctacaatgcctcagaagaccatccatgtcccagctggcagaccagtagagctggtgatacctattgctggccgtccacctcctgctgcttcctggttctttgctggttctaaactgagagaatcagagcgtgtcacagttgaaactcacactaaagtagctaaattaaccatccgtgaaaccactatcagagatactggagaatacacacttgaattgaagaatgttaccggaactacttcagaaaccattaaagttatcattcttgacaagcctggtccaccaacaggacctattaagattgatgaaattgatgctacatcaattaccatttcctgggaaccacctgaattggacggtggtgctccactgagtggttatgtggtagaacaacgtgacgctcatcgtccaggatggctgcccgtttctgaatcagtgactaggtccacgtttaagtttaccagactcaccgaaggaaatgagtatgtgttccgtgtggctgcaacaaaccgcttcgggattggctcttacttgcagtctgaggtcatagagtgtcgcagcagcatccgtattcctggacccccagaaacattacagatatttgatgtttcccgtgatggcatgacacttacttggtacccaccagaggatgacggtggctcccaagtgactggatatattgtggagcgcaaagaagtgagagcagatcgatgggtccgtgtaaataaagtacctgtgacaatgacacggtaccgctccactggccttactgaaggcttagaatatgaacaccgtgtcacagccattaatgcaagagggtctgggaaaccaagtcgtccttccaaacccatcgttgccatggatccaattgctcctccaggaaagccacaaaacccaagagttactgatacaacaaggacatcagtctccctggcctggagtgttccagaagatgaaggaggatctaaagtcacaggctacttgattgaaatgcaaaaagtagatcaacatgaatggaccaagtgtaacaccactccaaccaagattcgagagtatactctaacacacctacctcagggtgcagaatacaggttccgcgtcctagcttgtaatgctggtggacctggtgagcctgctgaggtaccaggaacagtcaaagtcactgaaatgcttgaatatcctgattatgaacttgatgaaagataccaagaaggtatctttgtaaggcaaggtggcgtcatcagacttaccataccaatcaaaggaaaaccattcccaatatgtaaatggaccaaggaaggccaggatattagtaagcgtgccatgattgcaacatctgaaacacacactgagcttgtgatcaaagaagcagacaggggtgattctggcacttatgacctggttctggaaaataaatgtggcaagaaggctgtctacatcaaggtcagggtgataggaagtcccaacagtccagaagggccactggaatatgatgacatccaagtccgctctgtgagggtcagctggagacctcctgctgatgatggtggtgctgacatcttaggctacatcctcgagagacgagaagtgcctaaagccgcctggtataccattgattccagagtccgaggtacatctctggtggtaaaaggcctcaaagagaatgtagaataccatttccgtgtttcagcagaaaaccagtttggcataagcaaacccttgaaatctgaggaaccagtcacaccaaaaacaccattgaatcctccagaacctccaagcaatcctccagaagtactcgatgtaaccaagagttctgttagcttgtcctggtcccggcccaaagatgatggtggttctagagtcacaggctactacatcgaacgcaaagagacatccactgacaagtgggtcagacacaacaagactcagatcaccaccacaatgtacactgtcacagggcttgttcccgatgctgagtatcagttccgcatcatcgcacagaatgatgttggcctgagtgagaccagccctgcttctgaaccagttgtttgcaaagatccatttgataaaccaagccaaccaggagaacttgagattctttcaatatccaaagatagtgtcactctacagtgggagaaacctgaatgtgatggtggtaaagaaattcttggatactgggttgaatatagacagtctggagacagtgcctggaagaagagcaataaggaacgtattaaggacaagcaattcacaataggaggtttgctggaagctactgagtatgaattcagggtttttgctgagaatgagactgggctgagcagacctcgcagaactgctatgtctataaagactaaactcacatctggagaggccccaggaatacgcaaagaaatgaaggatgttaccacaaaattgggtgaagctgctcaactctcatgccagattgttggaaggcctcttcctgacattaaatggtacagatttggtaaagagctcatacaaagccggaaatacaaaatgtcttcagatggacgcacacacactcttacagtaatgacagaggaacaggaagatgaaggtgtttatacctgcatagccaccaatgaggttggagaagtagaaaccagtagtaagcttctcctgcaagcaacaccgcagttccatcctggttacccactgaaagagaaatattatggagctgtgggttccacacttcggcttcatgttatgtacattggtcgtccagtacctgccatgacttggttccatggtcagaaacttttgcaaaactcagaaaacattactattgaaaacactgagcactatactcatcttgtcatgaagaatgtccaacgtaagactcatgctgggaaatacaaagtccagctcagcaatgtttttggaacagttgatgccatccttgatgtggaaatacaagataaaccagacaaacctacaggaccaattgtgatcgaagctctattgaagaactccgcagtgatcagctggaaaccacccgcagatgacggaggctcctggatcaccaactatgtggtggaaaaatgtgaggccaaggagggggctgaatggcaattggtgtcttcagccatctcagtgacaacctgtagaattgtgaacctcacagaaaatgctggctattacttccgggtttcagctcagaacactttcggcatcagtgaccctctagaagtgtcctcagttgtgatcattaagagtccatttgaaaagccaggtgctcctggcaaaccaactattactgctgtcacaaaagattcttgtgttgtggcctggaagccacctgccagtgatggaggtgcaaagattagaaattactaccttgagaagcgtgagaagaagcagaataaatggatttctgtgacaacagaagaaattcgagaaactgtcttttcagtgaaaaaccttattgaaggtcttgaatacgagtttcgtgtgaaatgtgaaaatctaggtggggaaagtgaatggagtgaaatatcagaacccatcactcccaaatctgatgtcccaattcaggcaccacactttaaagaggaactgagaaatctaaatgtcagatatcagagcaatgctaccttggtctgcaaagtgactggtcatccaaaacctatcgtcaaatggtacagacaaggcaaagaaatcattgcagatggattaaaatataggattcaagaatttaagggtggctaccaccagctcatcattgcaagtgtcacagatgatgatgccacagtttaccaagtcagagctaccaaccaagggggatctgtgtctggcactgcctccttggaagtggaagttccagctaagatacacttacctaaaactcttgaaggcatgggagcagttcatgctctccgaggtgaagtggtcagcatcaagattcctttcagtggcaaaccagatcctgtgatcacctggcagaaaggacaagatctcattgacaataatggccactaccaagttattgtcacaagatccttcacatcacttgttttccccaatggggtagagagaaaagatgctggtttctatgtggtctgtgctaaaaacagatttggaattgatcagaagacagttgaactggatgtggctgatgttcctgacccacccagaggagtcaaagttagtgatgtctcacgagattctgtcaacttaacatggactgagccagcctctgatggtggcagcaaaatcaccaactacattgttgaaaaatgtgcaactactgcagaaagatggctccgtgtaggacaggcccgagaaacacgttataccgtgatcaacttatttggaaaaacaagttaccagttccgggtaatagctgaaaataaatttggtctgagcaagccttcagagccttcagaaccaaccataaccaaagaagataagaccagagctatgaactatgatgaagaggtagatgaaaccagggaagtctccatgactaaagcatctcactcttcaaccaaggaactctatgagaaatatatgattgctgaagatcttgggcgtggtgagtttggaattgtccatcgttgtgttgaaacatcctcaaagaagacatacatggccaaatttgttaaagtcaaagggactgatcaggttttggtaaagaaggaaatttccattctgaatattgctaggcatagaaacatcttacacctccatgaatcatttgaaagcatggaagaattagttatgatctttgagtttatatcaggacttgacatatttgagcgcattaacacaagtgcttttgaacttaatgaaagagaaattgtaagttatgttcaccaggtctgtgaagcacttcagtttttacacagtcataatattggacactttgacattagaccagaaaatatcatttaccaaaccagaagaagctctaccattaaaatcatagaatttggtcaagcccgtcagctgaaaccaggggacaacttcaggcttctattcactgccccagaatactatgcacctgaagtccaccagcatgatgttgtcagcacagccacagacatgtggtcacttggaacactggtatatgtgctattgagtggtatcaacccattcctggctgaaactaaccaacagatcattgagaatatcatgaatgctgaatatactttcgatgaggaagcattcaaagagattagcattgaagccatggattttgttgaccggttgttagtgaaagagaggaaatctcgcatgacagcatcggaggctctccagcacccatggttgaagcagaagatagaaagagtcagtactaaagttatcagaacattaaaacaccggcgttattaccacaccctgatcaagaaagacctcaacatggttgtgtcagcagcccggatctcctgtggtggtgcaattcgatctcagaagggagtgagtgttgctaaagttaaagtggcatccattgaaattggcccagtttctgggcagataatgcatgcagttggtgaagaaggaggacatgtcaaatatgtatgcaaaattgaaaattatgatcagtctacccaagtgacttggtactttggcgtccgacagctggagaacagtgagaaatacgaaatcacctacgaagatggagtggccatcctctatgtcaaagacattaccaaattagatgatggtacctacagatgcaaagtagtcaatgactatggtgaagacagttcttatgcagagctatttgttaaaggtgtgagagaagtctatgactattactgccgtagaaccatgaagaaaattaagcgcagaacagacacaatgagactcctggaaaggccaccagaatttaccctgcctctctataataagacagcttatgtaggtgaaaatgtccggtttggagtaactataactgtccacccagagcctcatgtaacatggtataaatcaggtcagaaaatcaaaccaggtgacaatgacaagaagtacacatttgagtcagacaagggtctttaccaattaacaatcaacagtgtcactacagatgatgacgctgaatatactgttgtggcaaggaacaaatatggtgaagacagctgtaaagcaaagctgacagtaaccctacacccacctccaacagatagtaccttaagacccatgttcaaaaggttactggcaaatgcagaatgccaagaaggccaaagtgtctgctttgagatcagagtgtctggcatccccccaccaacattaaaatgggagaaagatggtcagccactgtccctcgggcctaacattgaaattatccatgaaggcttggattattatgctctgcacatcagggacactttgcctgaagacacgggttattatagagtcacagccactaacacagctgggtccaccagctgccaggctcacctacaagtggaacgcctgaggtacaagaaacaggaattcaagagtaaggaggagcatgagcgacacgtacaaaaacaaattgacaaaaccctcagaatggctgaaattctttctggaactgaaagtgtaccactgacacaggtagctaaagaggctctgagagaagctgctgtcctttataaaccggctgtaagcaccaagactgtaaaaggggaattcagacttgagatagaagaaaagaaggaggagagaaaactccggatgccttatgatgtaccagagccacgcaagtataagcagactaccatagaagaagaccaacgcatcaagcagttcgtgcccatgtctgacatgaagtggtataaaaagatacgtgatcagtatgaaatgcctgggaaacttgacagagttgtacagaaacgacccaagcgcatccgcctttcaagatgggaacagttctatgtgatgcctcttccacgcattacagatcaatacagacctaaatggcgtattcctaaactgtcccaagatgatcttgagatagtgagaccagcccgccggcgtacaccttctcctgattatgacttttactaccgacctagaagacgttctcttggggacatctctgatgaagaattactcctccccattgatgactacttagcaatgaaaagaacagaggaagagaggctgcgtcttgaagaagagcttgagttaggtttttcagcttcacccccaagtcgaagccctccacactttgagctttctagcctacgttactcttcaccacaagctcatgtcaaggtggaggaaacaagaaaagacttcaggtattcaacctatcacatcccaacgaaggctgaagctagtacaagttatgcagaactgagggaacggcatgcccaggctgcgtacagacagccaaagcaacggcaaagaatcatggctgagagggaggatgaagagttgcttcgcccagttacgaccacccagcatctctcagaatacaaaagcgaacttgacttcatgtcaaaggaggaaaagtctagaaagaaatcaaggcgacaaagagaagtgacagaaataacagaaattgaggaagaatacgaaatctcaaaacatgctcaaagagaatcatcctcatctgcgtctagactactgagacgacggcgctccctgtctccaacttatattgagttaatgaggccagtgtctgagctgatccggtcacgtccacaaccggctgaggaatacgaagatgacacagaaagaaggtcacctactccagagagaactcgcccacgatcccccagccctgtgtctagtgagagatcactctcgagatttgagaggtctgcaagatttgatatcttttccaggtatgagtccatgaaagctgctttaaaaactcagaagacatcagaaaggaagtatgaagttttgagtcagcagcctttcacactggaccatgcccctcgaatcacactgagaatgcgctcgcacagggtaccatgtggccaaaatacacgttttattttaaatgttcagtctaagccaactgccgaggttaaatggtaccacaatggtgtggaactccaagaaagcagtaagattcattacaccaacacgagtggagtcctcaccctggaaattctggactgtcatactgatgacagtggaacctaccgtgctgtgtgcaccaactacaagggcgaagcttctgactatgcaacgttggacgtgacaggaggggattataccacctatgcttcccaacgcagagatgaagaggtccccagatctgttttccctgagctgacaagaacagaggcgtatgctgtttcatcatttaagaaaacatctgagatggaagcttcgtcttctgtcagggaagtgaaatcacagatgacggagacaagggaaagtctctcctcatatgaacactctgcatctgcagaaatgaaaagtgctgcattagaagaaaagtcactggaagaaaaatccacaaccagaaagatcaagacgactttggcagcaagaattctaacaaagccacggtccatgaccgtctacgagggcgagtctgcaaggttttcttgtgacaccgatggtgagccggtaccaactgtgacctggctgcgtaaaggacaagtgctaagtacttctgcccgccaccaagtgaccaccacaaagtacaaatcaacctttgagatctcttcagtccaggcttccgatgagggcaattacagcgtggtggtagaaaacagtgaagggaaacaagaagcagagttcactctgactattcaaaaggccagggtaactgaaaaggctgtgacatcaccaccaagagtcaaatccccagagcctcgggtgaaatccccagaagcagttaagtctccaaaacgagtgaaatctccagaaccttctcacccgaaagccgtatcacccacagagacaaaaccaacaccaacagagaaagttcagcacctcccagtctctgccccaccaaagattactcagttcctgaaagcagaagcttctaaagagattgcaaaactgacctgtgtggttgaaagcagtgtattaagggcaaaagaggtcacctggtataaagatggcaagaaactgaaggaaaatgggcatttccagtttcattattcagcagatggtacctatgagctcaaaatcaataacctcactgaatctgatcaaggagaatatgtttgtgagatttctggtgaaggtggaacgtctaaaaccaacttacaatttatggggcaagcctttaagagtatccatgagaaggtatcaaaaatatcagaaactaagaaatcagatcagaaaaccactgagtcaacagtaaccagaaaaactgaaccaaaagctcctgaaccaatttcctcaaaaccagtaattgttactgggttgcaggatacaactgtttcttcagacagtgttgctaaatttgcagttaaggctactggagaaccccggccaactgccatctggacaaaagatggaaaggccattacacaaggaggtaaatataaactctctgaagacaagggagggttcttcttagaaattcataagactgatacttctgacagtggactttatacttgtacagtaaaaaattcagctggatctgtgtcctctagctgcaaattaacaataaaagctataaaagatactgaggcacagaaagtctctacacaaaagacttctgaaattacacctcagaagaaagctgttgtccaagaggaaatttcccaaaaagccctaaggtctgaagaaattaagatgtcagaggcaaaatctcaagaaaagttagccctcaaagaggaagcttcaaaggttctgatttctgaagaagtcaagaaatcagcagcaacctccctggaaaaatccattgtccatgaggaaatcactaaaacatcacaggcatcagaagaagtcagaactcatgctgagattaaagcattttctactcagatgagcataaacgaaggtcaaagactggttttaaaagccaacattgctggtgccactgatgtgaaatgggtactgaatggcgtagagcttaccaactctgaggagtaccgatatggtgtctcaggcagcgatcagaccctaaccatcaagcaagccagtcacagagatgaaggaatcctcacctgcataagcaaaaccaaggaaggaatcgtcaagtgtcagtatgatttgacactgagcaaagaactctcagatgctccagccttcatctcacagcctagatctcaaaatattaatgaaggacaaaatgttctctttacttgtgaaatcagtggcgagccatcccctgaaatcgaatggtttaaaaacaacctgccaatttctatttcttcaaatgtcagcataagccgctccagaaatgtatactcccttgaaatccgaaatgcatcagtcagcgacagtggaaagtacacaattaaggccaaaaatttccgtggccagtgttcagctacagcttccttaatggtccttcctctagttgaagaaccttccagagaggtagtattgagaacaagtggtgacacaagcttgcaaggaagcttctcgtctcagtcagtccaaatgtctgcctccaagcaggaggcctccttcagcagtttcagcagcagcagtgctagcagcatgactgagatgaaatttgcaagcatgtctgcccaaagcatgtcctccatgcaagagtcctttgtagaaatgagttccagcagctttatgggaatatctaatatgacacaactggaaagctcaactagtaaaatgcttaaagcaggcataagaggaattccgcctaaaattgaagctcttccatctgatatcagcattgatgaaggcaaagttctaacagtagcctgtgctttcacgggtgagcctaccccagaagtaacatggtcctgtggtggaagaaaaatccacagtcaagaacaggggaggttccacattgaaaacacagatgacctgacaaccctgatcatcatggacgtacagaaacaagatggtggactttataccctgagtttagggaatgaatttggatctgactctgccactgtgaatatacatattcgatccatttaagagggcctgtgcccttatactctacactcattcttaacttttcgcaaacgtttcacacggactaatctttctgaactgtaaatatttaaagaaaaaaaagtagttttgtatcaacctaaatgagtcaaagttcaaaaatattcatttcaatcttttcataattgttgacctaagaatataatacatttgctagtgacatgtacatactgtatatagccggattaacggttataaagttttgtaccatttattttatgacattttacaatgtaagttttgaaactaactgttggtaggagaaagtttcttatggaacgaataccctgctcaacatttaatcaatctttgtgcctcaacatactgttgatgtctaagtatgcctcagtgggttgagaaaatccccattgaagatgtcctgtccacctaaaagagaatgatgctgtgcatatcacttgatatgtgcaccaatacctactgaatcagaaatgtaaggcattggtgatgtttgcatttaccctcctgtaagcaacactttaacgtcttacattttctctgatgatgtcacacaaaattatcatgacaaatattaccagagcaaagtgtaacggccaacactttgttcgctcattttacgctgtctctgacataaggagtgcctgaatagcttggaaaagtaacatctcctggccatcccttcatttaaccaagctattcaagtattcctatgccagagcagtgccaactcttggaggtcccagagtgcagccaatgcctttgtgtggtagttctaaattttaattgcacctgaaaaacctgggcacctaagcaatgagccacagcaaaaagtaaagaacaacaacaaaataaagctgttgttaaattttaaacaatattactaattgcccaaaatgtcaatttgatgtagttcttttcatgcaagtataaattcaattgttagttataattgttggacctccttgagatagtaacaacaaaataaagcaagctatctgcacctcaaaa

SEQ ID NO: 2953 - DNA, 101518 bp, Homo sapiens
agcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcaagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataagacaggaaactgagataactgctgcatccatggtggtagttgccactgcaaagtccacaaaactagaaacagtcccgggagctcaagaagaaactaccacacaacaagatcaaatgcacctaagttatgaaaagataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgatttaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatcacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagagtacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaagctcctgaatcaattttgcatgagaggattgaacaagagattgagatggaaatgaaagctgccccagtgatcaagaggaaaatcgaacccctggaagtagcactgggccacctagccaaattcacctgtgagatccaaagtgctcccaatgtccggttccagtggtttaaagctggccgagaaatttatgagagtgacaagtgttctattcgatcttcaaagtatatctccagccttgaaatcctgagaacccaggtggttgactgcggcgagtatacatgcaaagcttccaatgagtatggcagtgtcagctgtacagccacactaactgtgacagaggcatatccaccaacctttctctccagacctaagtcccttacaacttttgtgggtaaggcagccaagttcatctgcacagtgacagggactcctgtgatagaaaccatttggcagaaagatggtgctgcactctcaccttcacctaactggaggatttccgacgcagaaaacaaacacattttagaactctcaaaccttaccattcaagatagaggagtttattcttgtaaggcttctaacaagtttggagcagacatctgccaagcagagttgatcatcattgataagccacatttcattaaagaattagagcctgtgcagtccgctatcaataagaaggtccaccttgagtgccaagtagatgaagacagaaaagtcacagttacgtggagcaaagatgggcaaaaactccccccagggaaagattataagatctgttttgaagataaaatagcaacacttgagattcctttggccaaactgaaagattcaggaacctatgtctgtacagcttcaaatgaggctggaagcagctcctgctcagccacagtcactgtcagagagccaccatccttcgtgaagaaggtggatccctcttatttaatgctcccaggtgaatcagcacgcctccattgcaagctgaaaggctcacctgtgatccaggttacttggtttaaaaataacaaagaactcagtgaaagtaacacagtccgaatgtattttgtcaattctgaggctatacttgatattacggatgtaaaagttgaagacagtgggagttactcatgtgaagcagtgaatgacgtcggcagtgatagctgcagtactgaaatagttatcaaagaacctccttctttcatcaaaactcttgagcctgcagacatagtgagaggaacaaatgctctacttcagtgtgaagtctcaggcactggaccatttgaaattagctggttcaaagacaagaaacaaattcgaagtagtaaaaaatacagattgttttctcagaagtctcttgtgtgtctggagatcttttcgtttaatagtgcagatgttggtgaatatgaatgtgttgttgctaatgaagtcggcaagtgtggctgcatggcaacccacttactcaaagaacctccaacctttgtaaagaaagtagatgatttgattgcactaggaggacaaaccgttaccctgcaagctgctgtgagagggtcagagcccatttctgtcacatggatgaaaggtcaagaggtcatcagagaagacggaaaaatcaaaatgagcttttccaatggtgttgcagtcttgataatccctgatgttcagattagttttggaggcaaatacacgtgcctggctgaaaatgaagctggaagccaaacatctgttggggaattaatagttaaagaacctgccaaaatcattgagcgagcagaactgatccaggtgacagcaggagatcccgccacactggagtacacagtggcaggcacgccagaactgaagcccaaatggtacaaagatgggagacccttggtcgccagtaaaaaataccgaataagttttaaaaacaatgttgcccagctcaaattttattcagctgagctgcacgacagtggccaatacacatttgagatttccaatgaagtgggcagcagctcctgtgagactacattcactgtattagatcgagacattgctccattttttaccaaacccttgcgcaacgtggatagtgttgttaatggtacctgcagactggactgcaaaattgcaggctccctccccatgagggtgtcctggtttaaggatggcaaagaaatagctgcttctgacagatacaggatagcatttgtggaaggcacagcctctttggagatcatcagagtagacatgaatgatgcagggaatttcacttgtcgagccacaaattccgtgggaagcaaagacagcagtggagccctgattgtgcaagaaccacccagttttgtaactaaacccggctcaaaggatgttctgcctggctcagcagtctgcctgaagagcactttccaaggatctactcctctcacaatcagatggtttaagggcaacaaagagctggtttctggtggaagctgctatattaccaaagaagctttagagagttccctggaactctatttagtaaaaacctctgattcgggcacgtacacatgtaaagtcagcaatgtcgctggaggggtggaatgcagtgcaaacttgtttgtaaaagaacctgccacatttgttgaaaagttagagccatcacagctgttaaagaagggagatgccacccagctagcctgcaaagtaactggtacccctccaattaaaataacatggtttgcaaatgatagagaaattaaggagagcagcaaacacagaatgtcttttgtggagtctactgcagttctaagactgacagatgttggcatcgaagacagtggtgaatatatgtgtgaggcccaaaatgaggctggcagtgaccactgcagtagcattgtaatagtcaaagagtcaccttattttaccaaggaatttaagccaattgaagtcttaaaggagtacgatgtcatgttgctggctgaggtggcaggcactcctccctttgagatcacttggttcaaagataacacaatcctgcgaagtggtagaaagtataagactttcattcaggatcatctggttagcctgcagatcctcaagtttgtagctgcagatgctggcgaataccagtgtcgggtgaccaatgaggtgggcagcagcatctgcagtgccagggtgactttaagagaacccccatccttcataaagaagatcgagagtaccagctccctccggggaggcacagctgccttccaggccactctgaagggctccttgccaattacggtgacttggctaaaagacagcgatgaaatcactgaagacgataatataagaatgacctttgagaacaatgtggccagtttgtacctcagtggcattgaagtcaagcatgatgggaaatatgtctgtcaggccaaaaatgatgcaggaatacaaagatgttctgcattactctcagtaaaagaacctgcaacaatcaccgaggaagctgtgtctatagatgtcacccaaggagacccagccactttgcaggttaaattttcagggactaaggagattacagccaaatggtttaaagatggccaagaactgaccctgggctcaaaatataaaatcagtgtcactgatacagtctcaatactgaagattatttctacagaaaagaaagatagtggagaatatactttcgaggtccaaaatgatgttgggaggagcagctgcaaggctagaattaatgtattagatcttatcatacctccttcattcaccaaaaagctgaagaaaatggacagcattaaaggttctttcattgatttagaatgtatagtggctgggtcacatcccataagcatccagtggttcaaagatgaccaagaaatatcagctagtgaaaagtacaaattctcttttcatgacaatactgccttcttggaaatcagccagctggaaggtacagacagtgggacatacacttgttctgccacaaataaggcagggcacaaccaatgcagtgggcatctgacagtcaaagaacccccttactttgtggaaaagccacagtcacaagatgtcaatcccaacacaagggtacagttaaaggctcttgtgggtggcactgcacccatgacaataaagtggtttaaagataacaaagagttacactcaggagcagcccgctcagtttggaaggatgacacctctaccagtctagagctctttgcagccaaagctaccgattctggaacctacatttgccaactaagcaatgatgttggcacagcaaccagcaaagccactctctttgtaaaagaacctcctcaattcattaagaagcccagtccagtcttagtgctgaggaatggacagtcaacaacatttgaatgccaaataacaggcactcctaaaatccgagtgtcttggtatctagacgggaatgaaataacagccattcagaaacatggcatttccttcattgatggtttagccactttccagatttctggtgccagggtagaaaatagtgggacttatgtgtgtgaagctcgaaatgacgcaggcacggcgagctgcagcattgaactcaaagtgaaagaaccccccacctttatcagagagctgaagcctgtggaggtagtaaaatatagtgacgtggagctggagtgtgaagttacgggaacacctccgtttgaagtcacttggctgaagaataacagggaaattcgaagcagcaaaaaatacacattgaccgacagagtgtctgtgtttaacctccatataaccaagtgtgacccttcagacactggggaataccagtgcattgtatccaatgaaggcggcagctgctcatgcagtactagagttgccctgaaagaaccaccatcattcattaagaagatagaaaataccactactgttttgaaaagttctgccacctttcagagtaccgtggcaggttctcctcctatttctataacctggctaaaggatgatcagattcttgatgaagatgataatgtctatatttcatttgtggacagtgtggccacacttcaaatcagaagtgtggataatggacacagtgggagatatacctgtcaagccaagaatgagtcaggagttgagaggtgttatgctttccttttagtacaagaaccagctcaaatcgtagagaaagctaaatcagttgatgttacggagaaagatcccatgaccttggaatgtgttgtggctggaacaccagaactcaaagtgaaatggcttaaagacgggaaacaaatagttcccagtagatacttttcaatgagttttgaaaataacgtggccagttttagaattcagtcagtaatgaagcaggacagcggtcagtacactttcaaggtggaaaatgacttcggaagcagtagctgtgatgcctacttaagagtgctagatcaaaatattcctccatcattcaccaaaaaattaaccaaaatggataaagttctgggctcttctattcatatggagtgcaaggtgtctggttcacttcccattagtgctcagtggtttaaggatggaaaagaaatatctacaagtgcaaaatacagacttgtgtgccatgagagatctgtgtctctggaagttaataatctggaattagaagatactgcaaattacacatgcaaagtgtcaaatgtagcaggagatgatgcatgcagtggcatcttaactgtgaaagaaccaccaagcttcctagtgaaacctgggcgacagcaagccatacctgattctacagtggaatttaaggcaatactaaaaggaacaccaccatttaaaataaaatggtttaaggatgatgtggaacttgtctcaggtcctaaatgtttcattggcttggaagggtcgactagcttcttaaatctctactcagtggatgcttctaagactggacagtatacttgccatgttaccaatgatgttggtagcgactcttgtactacgatgttgcttgtgacagaaccaccaaagtttgtaaagaaattagaagcctccaaaattgtgaaagcaggtgactcttcacgacttgaatgcaagatagctggatccccagaaatcagagttgtgtggttccgaaatgaacatgaacttccagccagtgataagtacagaatgactttcattgactcagtggccgtcatacagatgaacaatctcagtactgaggacagtggagatttcatttgtgaggctcagaatcccgctggcagcacaagctgcagtaccaaggttatagtaaaagagccacctgtttttagcagcttccctcctatagtagaaacccttaaaaatgctgaagtcagtcttgaatgtgaactttcgggaacaccaccgtttgaggtggtatggtacaaagacaagcggcaactcagaagcagcaagaaatacaagattgcatccaaaaacttccacacaagtattcacattctcaatgtggacacttcagacatcggtgaataccactgcaaagcacagaatgaagtgggaagtgatacttgtgtttgtactgtaaaattgaaagaaccaccaagatttgtctccaaactgaacagcctcactgttgtagccggagagcctgctgaattacaagcatccatagaaggcgcccagcctatttttgtccagtggcttaaagagaaggaagaagtgattagagaaagtgaaaacatcaggattacatttgtggaaaatgttgcaactctacagtttgcaaaagcagagccagctaatgctggaaagtatatctgccaaatcaagaatgatggtggaatggaggagaacatggccacactgatggtcttagagcccgcagtcattgttgagaaggcaggaccgatgacggtgactgtaggagaaacgtgcactctggagtgtaaggtggctggcactccggaactctctgttgaatggtacaaggatggaaagctgttgaccagcagccaaaaacacaaatttagcttctacaacaaaatctcttccttaaggattctctcagttgaaaggcaagatgcaggcacatacactttccaggttcaaaataatgttgggaaaagcagctgcacagctgtggttgatgtttcagaccgagcagttcctccctctttcacacgaagactgaaaaatactggtggggtgttaggtgcttcttgcatcttggaatgcaaagtagctggatcatcacctatttcagttgcctggtttcatgagaaaaccaagattgtcagtggagcaaagtaccaaaccacattttcagataatgtctgcacattgcagttgaattctctggattcctcagatatgggcaattacacatgcgtggctgctaatgtcgctgggtctgatgaatgtcgtgcagtgctaactgtacaagaaccaccctcttttgtgaaagaacctgaacctttggaagtactaccaggcaaaaatgtaaccttcacaagcgttattagaggaacccctccattcaaagtcaactggttcagaggtgccagagaactagtgaaaggagaccggtgcaacatctattttgaagacactgtggcagaactggaattatttaatattgacatatctcagagtggggaatacacctgtgtggtttctaacaacgctggccaagcatcttgcactacccgtctctttgtgaaagaaccagctgcatttttgaagagattaagtgatcattctgtagaaccagggaagtccataattctggagagcacctacactggaacacttccaatttctgtcacttggaaaaaggatggttttaacataactacctctgaaaaatgtaacatagtcacaacagagaaaacttgtatcctggaaattctgaatagcacaaaaagagatgcagggcagtattcctgcgagattgaaaatgaggcaggaagggatgtttgtggagctctggtatctacattagaaccgccttattttgttacggaactggaacctctggaggcagcagttggagattcggtttctttacaatgccaagttgctgggacaccagaaattacagtgtcttggtacaaaggagataccaaattacggccaactcctgaatacaggacctactttacaaacaatgtggccacacttgtttttaataaagtgaacatcaatgacagtggagagtacacatgcaaagcagaaaatagtataggaactgcttcttctaagactgtgttcagaattcaagagcgccaactcccaccttcttttgcaagacaattaaaggacattgaacaaactgtggggttacctgttacactcacttgtcgattaaatggctctgcacccatccaagtgtgctggtatagagatggagtacttttaagagacgatgaaaatctacagacttcatttgtagataatgtggcaactttaaaaattttgcaaactgacttgagtcactctggccagtactcttgctcagcttccaacccacttggaacagcatcttctagtgctagactcacagcaagagaacccaagaaatctcccttctttgacatcaagcctgtatctatagatgttattgctggagaaagtgctgattttgagtgtcatgttactggtgctcaaccgatgcgaatcacttggtcaaaagataacaaggagatccgtcctggaggaaactatacaatcacatgtgtgggaaacactcctcatttgagaattcttaaagtaggcaaaggagactctggtcaatatacttgccaagcaaccaatgatgttggcaaagacatgtgctcagctcagctcagtgtaaaagaacctccaaagtttgttaagaaattagaagcttcaaaagttgcaaagcagggagaatccattcaactggaatgtaaaataagtggctccccagaaatcaaagtttcatggttccgaaatgacagcgaacttcatgaaagttggaaatacaacatgtcattcattaattctgtggcattgcttacgatcaatgaagctagtgctgaagacagcggggactacatttgtgaggctcataatggtgttggtgacgccagctgcagcacagcgttgacagtgaaagcacctcctgttttcacccagaagccttctccagtaggagctcttaaaggttctgatgtgattctccaatgtgaaatttcgggaactcccccatttgaagtagtatgggttaaagatcgaaagcaagttagaaacagcaagaaatttaaaatcacttcaaaacattttgatacaagtcttcatatccttaatcttgaagcctccgatgtcggggaatatcactgcaaagctactaatgaggtgggaagtgacacgtgttcttgctctgtcaagttcaaagaacctccacgattcgtgaaaaagctaagtgacacctcaacccttattggggatgctgttgagttacgggccatagtggagggcttccagccaatttctgttgtctggctgaaagatagaggtgaagtcatcagagagagtgaaaataccaggatttcattcattgataacattgcaaccctccagctggggagtccagaagcatctaattctggaaaatatatatgccaaatcaaaaacgatgctggaatgagagaatgctctgcagtcttgactgtactagaaccagcaagaatcatagagaagcccgaacccatgactgtcactactggaaatccttttgcattagagtgtgtagtgactggaacaccagaactctcagccaagtggttcaaagatggaagagaattgtctgcagacagcaaacatcacattacattcatcaataaagtggcttcccttaaaatcccctgtgccgaaatgagtgacaaaggattatatagctttgaagtgaaaaacagtgttggcaaaagtaactgcactgtatccgtccatgtttctgatcggattgtgcctccttccttcatccgcaagctgaaagacgtgaatgccatcctgggggcctcagttgttttggagtgccgagtctctggctcagccccgatttcagttggctggtttcaggatggaaatgagattgttagtgggcccaaatgtcagtccagcttttcggaaaacgtctgtactttgaatctgagcttgttggagccctccgacacaggcatatacacgtgtgtggctgccaatgtagctggttccgatgagtgctcagcagtcctgactgtgcaagaaccaccatcttttgaacaaacccctgattctgtggaagttttgcctggaatgagcctcacattcaccagtgtcatcagaggcacccctcctttcaaggtcaagtggtttaaaggcagcagggaactggtgcctggggagtcatgcaacatctctctggaagattttgtcacagaactggagttgtttgaggtgcagccattagaaagtggagactattcttgcctcgttacaaatgatgctggcagtgcttcctgtaccacacatctttttgtgaaagaaccagccacctttgtgaaaagattggctgatttcagtgttgagacaggaagccccatagttctcgaggccacatacactggcacacctccaatctcagtgagctggataaaggacgagtatcttatttcacaatctgagagatgcagtattactatgacagaaaaatctaccatactggaaattcttgagagcacaatagaggattatgcacagtacagctgcctgatagaaaatgaggctggtcaagatatctgtgaagctctggtgtctgtcttagaaccaccgtactttattgaacctctggaacatgtggaagcagtcattggagaacctgcaactttacagtgtaaagtggatggaactccagaaattagaatttcttggtataaagaacacacaaagctacgatcagctcctgcatataaaatgcaattcaaaaataacgttgcttccttagtaatcaacaaagtggatcacagtgatgtgggagagtattcatgcaaggcagacaacagtgtgggggcagtcgcttcttcagctgtgcttgttatcaaagagcgcaaacttccacctttctttgcaagaaaactgaaagacgttcatgagactctaggcttcccagttgcatttgaatgccgcatcaatggctcagaacctcttcaagtgtcttggtacaaggatggggttcttttgaaagatgatgctaatttgcagacatcttttgttcataatgtagcaactcttcagattttacaaactgaccagagccacatagggcagtataattgctctgcttctaatcctcttgggactgcttcatccagtgccaagctcattctctcagagcatgaagtgcctcctttctttgatctaaagcctgtatcagtagatcttgctcttggagaaagtggtacttttaaatgtcatgtaactgggactgcaccaatcaaaatcacttgggccaaagataaccgagagattcgccctggaggcaactacaagatgactttggtagaaaatactgccactctgacagttctcaaagtaggcaaaggcgatgccgggcagtacacctgctatgcaagcaacatcgctggaaaagactcttgttctgctcatctgggtgtacaagaaccacccaggttcattaagaagctagaaccttcaagaattgtgaaacaggatgaattcacaaggtatgaatgcaaaatcggtgggtctccagaaatcaaagttttatggtataaggacgagactgaaattcaagagagcagtaaattcagaatgtcattcgttgactcggtggctgtgctggaaatgcacaatctcagtgttgaagacagtggagactacacctgtgaggcccacaatgcagcaggcagtgccagcagcagcacatccttaaaagttaaagaaccacccattttccgcaaaaagcctcatcctatagagacactgaaaggagctgatgttcaccttgaatgtgagcttcagggcactcccccatttcacgtttcttggtataaagacaagagagaacttaggagcggcaagaagtacaagataatgtctgagaacttcctaaccagtatccacatcctgaatgtcgatgctgcagacattggggaatatcagtgtaaagccacaaatgatgtgggaagcgacacttgcgttggttccatcgctctcaaagcaccaccaagatttgtgaagaagctcagtgacatatctactgtcgttggtaaagaagttcagctgcagactaccattgaaggcgctgaacccatttcagtggtgtggttcaaagataagggagaaatcgttagagaaagtgacaacatatggatttcttattcagaaaacattgcaaccttacagttttcaagagtggaaccagccaatgctggaaaatacacttgtcagatcaaaaacgatgctgggatgcaagagtgcttcgccacgctatccgttctcgagcctgcaacaattgtagaaaagccagaatccataaaagttaccacgggagacacctgtaccttggagtgtacagtagctggcacccctgaactcagtactaagtggtttaaggatggaaaagagctaacaagtgacaacaaatacaaaataagcttcttcaacaaagtatccggccttaagatcatcaatgtagcaccgagtgacagtggggtatacagttttgaggtgcagaaccctgttggcaaagacagctgcacagcttcattgcaggtttcagaccgaaccgttcctccttcattcacaagaaaattgaaagagacaaatggtctatccggctcctcagttgtaatggagtgtaaagtctatgggtcacctccaatctctgtctcctggttccatgaaggaaatgagatcagtagtggaaggaaataccagaccaccctgacagataatacttgtgctttaactgtgaacatgctggaagaatcagacagtggtgactacacatgtatagctactaatatggctggttctgatgaatgtagtgctcctttgactgtgagagaaccaccatcttttgttcagaaacctgatcccatggatgttttaactgggaccaatgtaactttcacaagtatcgtaaaaggaacacctcctttcagtgttagctggttcaaaggtagcagtgaactagtaccaggtgacagatgcaacgtgtctttggaggattcagttgctgaactggagttgttcgatgtagatacatcacaaagtggagaatatacttgcatagttagcaatgaagctggcaaggcttcttgtacaacacatctctacataaaagccccagccaaatttgtgaagaggctgaatgattacagcatagagaaaggaaaacccctgatcctagagggtacattcactggaactcctcccatttcggttacctggaagaaaaatggcataaatgtaactccttctcagaggtgtaatataactacgactgaaaaatcggcaatcctggaaattccaagtagcacagtagaggatgcaggacaatacaactgctacattgaaaatgcctctggaaaagattcctgttcagcacaaatactcatactagaaccaccgtattttgtcaagcagttggagccggttaaggtgtctgttggagattctgcctctctacaatgccagcttgctggaacccctgaaattggggtatcctggtataaaggagatacaaaattgagacccactacgacttacaaaatgcattttaggaataatgttgctacactggttttcaaccaggttgatattaatgatagtggagaatatatctgcaaagctgaaaacagcgtgggagaagtttctgcatcaactttccttaccgttcaagagcaaaaacttccaccatcattttctcgacaattgagagatgttcaagaaacagttggactgccagttgtttttgattgtgccataagtggatcagaacctatctccgtgtcttggtataaagacggcaagccattgaaagacagcccaaatgtacaaacatcatttttagacaatacagccacactcaatatttttaaaactgaccggagccttgcaggccagtattcctgcacagctacaaaccctataggctctgcttcttccagtgccaggctcattctcacagaggggaagaacccacccttctttgacatccgtcttgcccctgtggatgctgtggtgggagaaagtgctgactttgagtgccacgtcacgggcacacaaccgataaaggtcagctgggccaaagacagcagagaaatacgaagtggcggaaagtaccagattagttatctggaaaacagcgcccacctgacagtcctcaaagtagacaaaggagattctggacaatatacctgctatgctgtgaatgaagtgggaaaagactcttgcacagctcagctgaatataaaagagcggctcatcccaccaagtttcactaaaagactctcagagacagtagaagaaacagaagggaattctttcaaacttgagggacgtgtggctggttcccaacctataactgttgcctggtacaaaaataatatagagatacaaccaacttctaactgtgaaataacattcaagaacaacacgttagtgctgcaagtcagaaaagcaggcatgaacgacgctggtttgtacacatgcaaagtgtccaatgatgcaggctctgctctgtgcacgtcttcaatcgtcatcaaagaacctaagaagccacctgtatttgatcagcaccttactccagtaacagtgagtgaaggagaatacgtgcagctcagctgccatgtccagggatctgagccaattaggatccagtggttgaaggctggcagggaaataaagccttcagacagatgcagcttcagctttgctagtgggacagctgtactggaactcagagatgtggctaaagcagattcgggagattatgtgtgtaaagcttcaaatgtggctggaagtgacactaccaaatcaaaagtgaccattaaagacaaaccagctgtggccccagcaaccaagaaagctgcggtagatggaagactcttttttgtgtcagaacctcagagtatcagagtcgtagaaaaaaccactgcgaccttcattgcaaaagttggaggtgacccaatcccaaatgttaaatggacaaaagggaagtggagacagctgaaccaaggaggtcgtgttttcatccaccaaaaaggcgatgaagcaaaactggagattagggacaccacaaaaactgattctgggttataccgatgcgtggcatttaacgaacatggtgaaattgaaagtaatgttaacttacaggtggatgaaaggaagaaacaagagaaaattgaaggcgatcttagagcaatgctgaaaaagactccaatcttaaagaaaggagctggagaagaagaggaaattgatatcatggaacttctcaaaaatgttgatcctaaagaatatgaaaaatatgcccgcatgtatggaatcactgacttccgaggtcttcttcaagcatttgaactgctcaagcaaagccaagaagaagagacacatagactggaaattgaggaaatagagaggtcagagagggacgaaaaggaatttgaggaacttgtatcatttattcagcaaagactgtcacagacagagcctgtcactctgatcaaggacattgaaaatcagacagttttgaaagataatgatgctgtctttgaaattgacattaaaattaattatccagaaatcaagctttcgtggtacaaaggaactgaaaaactggaacccagtgataaatttgaaataagcattgatggtgaccgacatacactcagagtcaaaaactgtcaacttaaagaccagggcaattatcgattggtttgtggtccacacatcgctagcgctaaactaactgtaattgagcctgcatgggaacggcatcttcaggatgtgactctgaaagaaggccagacttgcaccatgacatgccaattttctgtaccaaatgtaaaatctgaatggttcagaaatggcagaatccttaaaccccaaggtagacataaaacagaagtggaacacaaagtccataaattgaccattgcagatgttcgagcagaagaccagggtcagtacacctgcaaatatgaagaccttgaaacttcagcagaactcagaatcgaagctgaaccaattcagtttacaaagcgcatacagaacatcgtggtgagtgagcatcagtctgccacctttgagtgtgaagtgtcctttgatgatgccattgtaacatggtacaaaggaccaacagaactgacagagagccagaaatacaacttcaggaatgatggccgctgccattatatgaccatccacaatgtgaccccagacgatgaaggtgtctactcggtcatcgctcggctggagccaagaggtgaagcaagaagcacggcagagctgtacctaacgacgaaagaaatcaaacttgagctgaagcctcctgatattcctgactccagagttccaatcccaaccatgcctatcagagcagtgccaccagaagaaatccctcctgtggttgctcctcctatcccccttttgctaccaacacccgaagaaaagaaaccaccaccaaaacgtattgaagttaccaaaaaggctgtgaagaaagatgccaaaaaagttgttgcaaagcccaaagagatgacaccacgtgaagagattgtcaagaagcctccacctcctactaccttaattccagcaaaagctcctgaaatcattgatgtatcctctaaagctgaagaagtaaaaataatgactataaccagaaagaaagaggttcagaaagaaaaagaagctgtgtatgagaaaaagcaagcagtccacaaggagaagagagtcttcattgaatctttcgaagaaccttatgacgaactggaggtagaaccatacacagagccatttgaacaaccttattatgaagaaccagatgaagactatgaagagattaaggtagaagctaaaaaagaagttcacgaggaatgggaagaagattttgaagaagggcaagaatactatgaaagggaagaaggctatgacgaaggggaggaagagtgggaagaggcttaccaagaaagggaagtaattcaagttcaaaaggaggtctatgaagaatcacatgagagaaaagttccagccaaagtacctgaaaagaaagcaccaccacctcctaaagttataaagaagccagtaattgaaaaaattgaaaagacttctcgaagaatggaggaagaaaaagttcaagtcaccaaagtacctgaagtttcaaagaagattgttccacaaaaaccttcccggactccagtacaggaagaagttattgaagtgaaagtaccagctgtgcatacaaagaagatggttatttcagaagaaaagatgttctttgcttctcacacagaggaggaggtgtcagtcacagtccccgaggtacaaaaggaaattgttactgaagagaaaattcacgttgccgtttccaaaagggttgaaccaccacctaaagtccctgagctacctgagaaaccagctccagaagaagtggcccctgttcctatccctaaaaaagtggagcccccagcaccaaaagttcctgaggttcccaagaaacccgtgccagaggagaaaaagccagttcctgtgcctaagaaggaacctgctgctcccccaaaagtcccagaggtgccaaagaaacctgtccctgaagaaaagattcccgttcctgttgcaaagaaaaaggaagctcccccagctaaagttcctgaagtacagaagagagttgtgacagaagaaaaaataaccattgtaactcaaagagaggaatctccaccaccagcagtgccagaaataccaaagaagaaagttcctgaagaaaggaaacctgttcctcggaaggaggaagaagttccaccaccaccaaaagtgccagctctgcctaagaaacccgtcccagaggagaaagttgcagtgccagttcctgtcgctaagaaagctcctcctccccgagctgaagtctctaagaaaactgttgtagaagaaaagagatttgttgctgaagaaaaactatccttcgcagttcctcaaagagtggaagtcacgcggcacgaagtatctgcagaggaggaatggagttactcagaagaggaggaaggtgtgtccatttcagtttatagagaagaagaaagagaggaggaggaagaagcagaggttacagaatatgaagtgatggaagagcctgaggaatatgttgtggaagaaaagctgcacattatttctaagagagtggaagctgagccagctgaagtgacagagaggcaggagaagaaaattgtactgaaaccaaaaattcctgctaaaatagaggagcctccaccggctaaagttcctgaagcacctaagaaaattgtgccagaaaagaaagttcctgctccagttcctaaaaaggaaaaggtgcccccacctaaagtgccagaagagccaaagaaaccagttccagaaaaaaaggttcctccaaaagtcattaagatggaagaacctctcccagccaaagtgactgagaggcacatgcaaattacccaggaagaaaaagttcttgttgctgtaactaaaaaagaggcgcctccaaaagcaagagtgccagaggaaccgaagagagctgtcccagaagaaaaagttctgaaactcaaacctaaaagagaggaggaaccaccagctaaagtgactgaattcagaaaaagagtggttaaagaagaaaaagtatcaattgaagctccaaaaagagaacctcaacccatcaaagaagtaactataatggaagagaaagaaagggcttataccctagaagaagaagctgtttcagtacaacgggaagaagaatatgaggaatatgaagaatatgattataaagaatttgaggagtatgaaccaacagaagaatatgaccaatatgaagaatacgaggagcgggagtatgaacgatatgaagagcatgaagaatacatcacagaaccagagaagcctatccctgtaaagcctgtcccagaagaaccagttcccacaaaaccaaaggccccaccggctaaagtgctgaagaaagctgtccctgaagaaaaagtaccagtgcccattcctaagaaactcaaacctccaccacccaaagtgcctgaagaaccaaagaaagtttttgaggaaaaaatacgtatttcaattaccaaacgtgaaaaagagcaggtgactgaacccgctgctaaagtgcccatgaagcccaagagggttgtcgcagaagaaaaagtacctgtccctagaaaagaagtagcaccacctgttagagtgccagaagtgcctaaagaacttgaaccagaagaggttgcctttgaagaggaagttgtaacccatgtagaagaatatcttgtagaagaagaagaagagtacattcatgaagaagaggagttcataactgaggaagaagtggtgccagtgataccagtcaaagtgcctgaggtacccaggaaacctgttccagaagagaagaaacctgttcctgttcccaagaagaaggaagctccaccggcaaaagtgcctgaggttcctaagaagccagaggagaaagttcctgtgcttattcctaaaaaggagaagcctccgccagcaaaagttcctgaagtgcccaagaaacctgtgccagaggagaaagtaccagtaccagttcctaaaaaggtggaagctccacctgccaaagtgccagaggtacccaagaagcctgtgcctgagaagaaggtgccagttcctgctcctaagaaagtggaggctccacctgcaaaagtgccagaggtgcccaagaagctcatcccagaagaaaagaaaccaacacctgttccgaaaaaagtggaagcaccaccacccaaagtgccaaagaaacgtgaaccagttccagttcctgtagctctacctcaggaagaggaagttctatttgaagaagaaattgttcctgaagaggaagttctacctgaggaagaggaagttctacctgaggaagaggaagttctacctgaagaagaggaagttctacctgaagaagaggaaattccacctgaggaagaggaagttcctcccgaagaagaatatgtacctgaggaagaagaatttgtacctgaagaagaagtccttccagaagttaaacctaaggtgccagtacctgcaccagtgcctgaaattaagaagaaagtgacagagaagaaagtggtcattcccaagaaagaggaggctccccctgccaaagttcctgaggtgcctaagaaggtggaagaaaaacgaatcattctccctaaagaagaggaagttctaccagttgaagtgactgaggagcctgaagaagagcctatttcagaagaagaaatcccagaagaaccacctagcatagaggaagttgaagaggtggcaccacctagagtgcctgaagtgattaagaaagcagtacctgaagcacctactcctgttcctaaaaaagtggaggcaccaccagctaaagtgtcaaagaaaattcctgaggaaaaagtacctgttcctgttcagaaaaaagaggcacccccagccaaagtgcctgaagtaccaaagaaagtcccagaaaagaaagtccttgtgcctaaaaaggaagctgttcccccagctaaagggagaactgtccttgaagaaaaagtatcagttgccttccgccaagaagtagtagtaaaagaaagactagaattagaagtagtagaagcagaagtggaagaaattccggaagaagaagagttccatgaagttgaagaatattttgaagaaggcgagtttcatgaagtagaagaattcatcaaattagaacaacatagagttgaagaagaacacagagttgaaaaagttcatagggtaatagaagtttttgaggctgaagaagtggaagtatttgaaaaaccaaaagctccacctaaagggcctgagatatctgagaaaatcatccctccaaaaaaaccgcccactaaagttgttcctcgaaaagagccaccagctaaagtaccggaggtgcctaagaaaattgtggtagaagaaaaagtacgtgttcctgaagagcccagagttccaccaactaaagtgcctgatgtgctgccaccgaaggaagtggtcccagaaaagaaagtaccggtgcctcctgccaaaaagccagaagctccacctcctaaagtgcctgaggctcccaaagaagttgttcctgaaaagaaagtgccagtgcctcctcctaaaaagcctgaagtgccacccacaaaagtcccagaggtgccaaaggcagctgtcccagaaaagaaggtgcctgaagctattcctcccaaaccggaaagtcctccccctgaagtgccagaggctccgaaagaagttgttcctgaaaagaaagtgccagcggctcctcctaaaaagcctgaagtcacacctgttaaagtgcctgaggctcccaaagaagttgttcctgaaaagaaagtgccagtgcctcctcctaaaaagcctgaagtgccacccacaaaagtcccagaggtgccaaaggtagctgtcccagaaaagaaggtgcctgaagctattcctcccaaaccggaaagtcctccccctgaagtgttcgaggagcctgaggaagttgccctagaagagcctcctgctgaagttgtggaagagccagagccagcggcgcctccacaagtgaccgtaccacctaagaaacctgtcccagaaaagaaagcacctgctgtcgttgccaaaaaacctgaactaccaccagtgaaagtgcccgaggtgcccaaggaggttgttcctgaaaagaaggtgcctctggtggttcccaaaaagccagaagccccacctgctaaagtgcctgaagttccaaaagaagttgttccagaaaagaaagtagctgttcccaaaaagccagaagtcccaccagcaaaagtgccagaagtgccaaagaaacctgtcttggaagagaaaccagctgttcctgttccagaaagagcggagtctcctcccccagaagtatatgaagaacctgaggaaattgctcctgaagaggaaattgctcctgaagaggaaaagccagttcctgttgcagaagaggaggaaccagaggttccacctccagcagtgcctgaagagcccaagaagatcatcccagagaagaaagttcctgtcatcaaaaaaccagaagcaccgcctcctaaagaacctgaacctgaaaaggttattgagaagccaaaactcaaaccaagacccccacctcctccacctgctccacctaaggaagatgtgaaggagaaaatattccaacttaaagctattccaaagaagaaagttcctgaaaaacctcaggttccagaaaaagtggagcttacacctctgaaagtgcctggaggtgaaaagaaagttcgcaaattacttccggaacgtaaacctgaaccaaaggaagaagttgttctgaaaagcgttctaagaaaaagacctgaagaagaagaacctaaagtagaacctaaaaaactagaaaaagttaaaaaacctgcagtaccagaaccaccacctccaaaacctgttgaagaggttgaagtacctactgttacaaaaagggaaaggaagattcctgaaccaacaaaagtgcctgaaatcaagccagcaatacctctccctgcacctgaaccgaaaccaaagcccgaagcagaagtgaaaacaatcaaaccacctcctgtggaacctgaaccaacccccatcgctgccccagtaacagtgccagtggttggaaagaaagcagaagccaaagcacctaaggaagaggctgccaagccaaaaggtcctatcaaaggtgtacccaaaaagactccttcaccaatagaagccgaaaggagaaagttaaggccaggaagtggtggagagaaacctcctgatgaagccccgttcacctaccagctaaaggctgtgccactgaagtttgtgaaagaaatcaaagacatcatcttgacagaatcagagttcgttggctcttcagcaatctttgaatgtttggtctccccttccactgcaattacaacctggatgaaagacggtagcaatatccgtgagagtcccaagcacaggtttattgcagatggtaaagacagaaagctgcacatcattgatgttcaactttccgatgctggtgaatacacctgtgttttacgtttgggaaacaaagaaaagacctccacggctaaacttgttgtagaagaacttcctgtgcgttttgtaaaaacactggaagaggaagtcacagtggtcaaaggacagccattgtacttgagctgcgagttaaacaaagagcgtgacgtggtctggaggaaggatggcaagattgtggtggagaaacctggccgaattgtgccaggcgtcattggcttgatgcgggctctgaccatcaacgatgcagatgacacagatgctggaacatacacagttactgtggaaaacgccaacaacctggagtgttcatcttgcgtaaaagtagtagaagtcattagagattggctggtgaaacctatacgagaccagcatgtgaaacccaaggggacagctatttttgcctgtgatatagcaaaagatactccaaacattaagtggttcaaaggatatgatgaaatccctgcggaaccaaatgataagactgaaatactgagagatggaaatcatctgtacctcaaaattaagaatgctatgccagaagatattgctgagtatgcagtggaaattgaaggaaaaagataccctgcaaagctgacacttggagagcgtgaagttgaactgcttaaaccaatagaggacgttaccatttatgagaaagaaagtgcaagctttgatgcagaaatctcagaggcagacattcctggacaatggaaactgaaaggagaacttctaaggccctcacctacttgtgaaatcaaagcagaaggtggaaaacgcttcttaactttgcacaaagtcaaactggaccaagctggtgaagtcctctaccaggcccttaatgcaattacaactgccattttgacagtaaaagaaatcgaacttgactttgctgtgcccctgaaggatgtcactgttccagaaaggcgacaggctcgattcgaatgtgtcctcacccgagaggcaaatgttatatggtccaaaggacctgatataattaagtcatctgacaaatttgatatcatcgctgatggaaagaaacatattcttgttattaatgattctcaatttgatgatgaaggggtctatactgctgaggtggagggcaagaagacctcagctcggttgtttgtcacaggtataagactgaaattcatgtcacctcttgaagatcaaacagtaaaagaaggtgaaacagcaacttttgtttgtgaactttctcatgaaaaaatgcatgtagtctggttcaaaaatgatgccaaactccatacaagcagaacagtactcatctcttctgagggcaagactcacaaattggaaatgaaagaagtgacattggatgatatatctcagataaaagctcaagtcaaggagctgagctccacagcacagctgaaggtcttagaggccgatccctacttcactgtgaaattacatgacaaaactgcagtggagaaggatgagattactttgaagtgtgaagtgagcaaagatgtaccagtgaaatggttcaaagatggtgaagagattgtcccttcacccaaatattctatcaaggcagatggcctgcgccgcatcttaaaaatcaaaaaggcggaccttaaagataaaggcgaatatgtgtgtgactgtggcacagacaagaccaaggcaaatgttactgttgaggctcgactaataaaagtggaaaagcctctgtacggagtagaggtgtttgttggtgaaacagcccactttgaaattgaactttctgaacctgatgttcacggccagtggaagctgaaaggacagcctttgacagcttcccctgactgtgaaatcattgaggatggaaagaagcatattctgatccttcataactgtcagctgggtatgacaggagaggtttccttccaggctgctaatgccaaatctgcagccaatctgaaagtgaaagaattgcctcttatcttcatcacacctctcagtgatgttaaagtcttcgagaaagatgaggctaagtttgagtgtgaagtatccagggagcccaaaacattccgttggctaaaaggaacccaggaaatcacaggtgatgacagatttgagcttataaaggatggcactaagcattcaatggtgatcaagtcagctgcttttgaagatgaagcaaaatacatgtttgaagctgaagataagcacacaagtggcaaactgatcattgaaggaatccggctcaaattcctcacccctctcaaagatgtaactgccaaagagaaggaaagtgctgtatttactgtggagttatctcatgataacatccgagttaaatggttcaagaatgaccagcgcctacacaccaccaggtcggtctcaatgcaagacgaagggaaaactcattcgatcacattcaaagacctgtctattgatgacacctcccaaattagagtagaagctatggggatgagttcagaagctaaactcactgtgcttgagggagacccatattttacaggaaaacttcaagattatactggtgtagagaaagatgaagttattctacagtgtgaaattagcaaagcagatgcaccagtgaaatggtttaaggatgggaaggaaataaagccatccaaaaatgctgttattaaggcagatggcaagaaacgcatgctaatcctaaagaaagccttgaaatcagatattggacagtacacctgtgactgtgggacagataagacctcaggaaaacttgacattgaggatcgggaaattaaactggtgcgacccctgcacagtgtggaggtgatggagactgagacagcacgctttgaaaccgaaatctctgaagatgatatccacgccaactggaaactcaagggagaggccctactccaaacacctgattgtgaaattaaggaagaaggcaaaatacactcccttgttttgcacaactgtcgcctggaccagacgggtggggtggatttccaagctgccaatgttaaatctagtgcccacctccgagttaagccacgagtaattggtcttctgaggcctttaaaggatgtcaccgtgactgcaggggaaacagccaccttcgactgcgagctctcctacgaagatatcccagtggaatggtatctcaaagggaagaaactagagcccagcgataaggtggtcccacgttcagaaggaaaagttcatacacttactctgagggatgtaaagttagaagatgctggggaagtccaactaacagcaaaagatttcaaaactcacgccaacctctttgtgaaagaacccccagttgaattcactaagcctcttgaggaccagacggtcgaagagggagccactgcagtgctggagtgtgaagtctccagagaaaatgctaaggtgaaatggttcaaaaatgggacagaaatcctcaaaagcaagaagtatgaaattgttgctgatggcagggtcagaaaacttgttatacatgactgtaccccagaggatattaaaacatacacttgtgatgctaaggattttaagacttcctgtaacctgaatgtcgtgcctcctcatgtggaattcttaagaccactcaccgaccttcaagttagagaaaaagaaatggctcgatttgagtgtgaactttcccgagaaaatgctaaggttaagtggtttaaagatggtgctgaaattaaaaagggcaaaaaatatgacatcatatccaagggagcagtgcgcattcttgtcatcaacaaatgtctactggatgatgaagctgaatattcctgtgaagtaaggacagcgagaacttctggcatgctgacagttctggaagaagaagctgtctttaccaaaaatcttgccaacattgaagttagtgaaacagacactataaaactggtttgtgaagtctccaaacctggcgcagaagtgatttggtataaaggggatgaggagatcattgaaacaggaagatatgaaatactgactgaaggacggaagagaatcctggtcattcagaacgctcaccttgaggatgctggcaactacaactgtcgactcccaagctctcgaaccgatggcaaagtcaaagtacatgaactggctgctgaatttatctcaaagcctcaaaaccttgaaatacttgaaggagaaaaggctgaatttgtctgctctatatcaaaagaaagctttccagtccagtggaagagggatgataagacacttgaatctggagataaatatgacgttattgctgatggtaaaaagagggtcctagttgtgaaagatgccacattacaagatatgggcacttacgttgtcatggtaggggccgccagagcagcagctcacttgacagtcattgaaaaactcaggatcgtagttcctcttaaggacacccgggtgaaggaacaacaggaagttgtcttcaactgtgaagtcaatactgaaggtgccaaagccaaatggttcagaaatgaagaagctatatttgatagttcaaaatacatcattctccaaaaagacctagtctacaccctcagaattagagatgcacacttagatgaccaagccaactataatgtgtctttgaccaatcacagaggtgaaaatgttaaaagtgcagccaatctaatagtagaagaggaagaccttaggattgttgagcctcttaaagatattgaaacaatggagaagaaatctgtcacattctggtgcaaggtgaatcgtctcaatgtaacactgaagtggaccaaaaatggtgaagaagtgccttttgacaaccgtgtctcatacagagttgataagtacaagcacatgttaaccattaaagactgtggcttcccagatgaaggtgaatacattgtcactgctggacaagataaatctgttgctgagcttctcatcatagaagccccgacagaatttgtggaacacttggaagatcagacagtcactgagttcgatgacgctgtcttctcctgccagctctccagagagaaagccaatgtaaaatggtacagaaatgggagagaaatcaaagaaggcaaaaaatacaaatttgaaaaagatggaagtatacacagactcattataaaagattgcaggctggatgatgagtgtgaatatgcttgcggggtagaagacaggaagtctcgtgctagactttttgtggaagaaattcctgttgagatcatcaggcctccacaagatattcttgaagcccctggtgctgatgttgtctttttagcagaactcaataaagataaggtggaagtccaatggctaagaaataacatggttgttgtccagggtgataaacaccagatgatgagtgaaggaaagatacatcgactacagatttgtgatattaagccccgtgaccagggtgaatacagatttattgccaaagacaaagaagccagagctaagcttgaactggcagctgcaccaaaaatcaagacagctgaccaagaccttgtggttgatgttggcaagcctctgacaatggtggtgccatatgatgcctaccccaaagcagaagctgaatggtttaaagaaaatgaacctttatctacaaaaaccattgatactacggctgaacaaacttctttcagaattttagaagccaagaaaggagacaaagggaggtataaaattgtgcttcagaacaaacatggaaaagcagaaggattcatcaatttaaaagttattgatgttcctgggccagtacgtaacttagaagtgacagaaacatttgatggtgaagtgagccttgcttgggaagaacctttaactgatggtggaagcaaaatcataggttacgttgttgaaagacgtgacattaagagaaagacctgggttctggccacagaccgtgcagagagttgtgagtttactgtcactggtctacagaaaggaggagttgagtacctattccgtgtgagtgcaagaaacagagttggcactggtgagccagtagaaactgacaatcctgtagaagcaaggagtaaatatgatgttccaggccctcctttgaatgtaaccatcactgatgtgaatcgatttggtgtctcactgacatgggaaccaccagagtatgatggaggtgctgagatcacaaactacgtcattgaattaagagacaagacttctatcaggtgggatactgccatgactgtgagagctgaagacctgtctgcaactgttactgatgtggtagaaggacaggagtacagtttccgagtgagagcccaaaatcgaattggagttggaaaaccaagtgcagccacacccttcgtcaaagttgctgatccaattgagagaccaagtcctcctgtaaacctaacttcctcagatcagactcagtcatcagttcagctcaaatgggaacctcctctgaaagatggaggaagcccaatattaggctatataattgagcgatgcgaagaaggaaaagataattggattcgttgcaatatgaaacttgtccctgaactgacttacaaggttaccggattggaaaaaggaaataaatatttatatagagtatctgcagaaaataaagctggtgtttcagatccatctgaaattcttggtcctctcaccgctgacgatgcatttgttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattgctcgcccaagtgcacccaaagaattgaaatttggtgatataaccaaggactcagtacatttgacttgggaaccacctgatgatgatggaggaagtccgttaactggatacgttgttgaaaaacgagaagtcagccggaaaacatggactaaagttatggactttgtgactgatctagaattcacagttcctgatcttgttcaaggaaaagagtacttatttaaagtttgtgctcgtaacaaatgtggccctggagaacctgcatatgttgatgaacctgtaaatatgtcaactcctgcaacggtacctgacccaccagagaatgttaaatggagagatcgaacagccaatagcatcttcttaacatgggatccacctaaaaatgatggtggttcacgcatcaaaggatatatagttgaaagatgtccacgtggttctgataaatgggttgcctgtggagaacctgttgcagaaacaaaaatggaagtgacaggtcttgaggaaggcaaatggtatgcctaccgcgtgaaggccttaaacaggcagggtgctagcaaaccaagcagacccacagaggaaatccaggctgtggacacacaagaggccccagaaatcttcctcgatgtgaagctccttgctggtctcactgtaaaagctgggaccaagattgaacttcctgccaccgtaaccggaaaacctgaacctaaaataacttggacaaaggctgatatgattctgaagcaggacaaaagaattaccattgaaaatgtccctaagaaatccacagtgactattgttgatagtaagagaagtgacactggcacatatatcattgaggctgtgaatgtgtgtggccgggccactgctgtggtggaagtgaacgtcttagataaacccggaccaccagctgcctttgacatcacagatgtaaccaatgagtcatgtcttctaacatggaacccaccacgcgatgatggtggatctaagatcacaaactatgttgtggagagacgagcaactgatagtgaagtgtggcacaagctctcatccaccgtcaaggatacaaacttcaaggccaccaaattaatccccaataaagagtacatcttcagagttgctgcagaaaacatgtatggtgttggtgaaccagttcaggcctctccaataacagccaaatatcagtttgatccacctggtcctccaactcgcctagaaccttctgatatcactaaagacgcagtgactctcacatggtgtgagccagatgatgatggtggcagcccaatcacaggatactgggttgaaagactggatcctgatacagataaatgggttagatgcaataagatgccagtaaaggacacaacatacagagtgaaaggtctcactaataagaaaaaatacagattccgtgtgttggctgaaaatcttgctggacctggaaaaccaagcaaatcaactgaaccaatcttaataaaggatcccatagatcctccatggccccctggaaaaccaactgtaaaagatgtaggcaaaacatcagtaaggttgaattggacaaaaccagaacatgatggaggtgcaaagattgagtcttatgtcattgaaatgctgaagactggaacagatgagtgggtcagagtggcggaaggggttcccaccactcagcacttgctcccagggctcatggaaggacaggaatactcattccgagttagagctgtgaataaggctggggaaagtgaacccagtgaacccagtgaccctgtgctttgccgggagaagctatatcctccatcaccaccacgctggcttgaagttattaatatcacaaaaaatacagcagacctaaaatggacagttcctgagaaagatggagggtcccccatcaccaactacattgtggaaaagagagacgtcaggcgaaaaggctggcaaacagtggataccactgtcaaggacaccaagtgcacagtcaccccactgactgagggctctttatatgtgttccgagttgctgcagaaaatgctataggacaaagcgactacaccgaaattgaggactctgtgctggccaaagacacctttaccactcctggaccaccctacgccctggcagtggttgatgtgacaaaacgacatgttgacctaaagtgggagccacctaaaaatgatggtggaagaccaatacagagatatgtcattgagaagaaagaaaggttaggtacccgttgggtgaaagctggaaagactgcaggacctgactgtaacttcagagtaactgatgtcatcgaaggaacagaggtccagtttcaggttcgggctgaaaatgaagctggagttggccacccaagtgaacccacagaaatcctatccattgaagatccaacaagtcctccctcaccaccccttgacctacatgtgactgatgctgggagaaaacacattgccattgcttggaagcctccagagaaaaatggtggaagtcctatcataggataccatgttgaaatgtgtccagtaggcactgagaaatggatgagagttaattctcgcccaataaaggacttgaaattcaaggttgaagaaggtgttgttcctgacaaagaatatgtcctgagagtgagagcagtcaatgctattggtgtcagcgagccatctgaaatctctgaaaatgtggttgccaaagacccagactgcaagccaacaattgacctggagactcatgacattattgttattgaaggtgaaaagttaagcattcctgttcccttcagagctgtcccagttccaactgttagttggcataaagatggcaaagaagttaaagcaagtgatagattaacaatgaagaatgatcacatctctgcacaccttgaagttcccaagagtgtccgtgcagatgccggaatttataccattacactggagaataagctcggctcagcaacagcctcaatcaatgtcaaagtcataggcctacctggaccatgcaaagatattaaagcaagtgacattaccaagagttcttgtaagttaacttgggaacctccagaatttgatggtggaaccccaattcttcattatgtcctggagcgcagagaagctgggaggagaacatatataccagtcatgtctggtgagaacaaactgtcatggactgtgaaggatctcataccaaatggtgaatacttcttccgtgttaaagcagtcaacaaggttggtggaggagaatatattgaactgaaaaatccagtcattgctcaagatccaaagcaaccccctgatccacctgtagatgtagaggttcataatcctacagcggaggcaatgactattacatggaagccacctttgtatgatggagggagcaagataatgggctacatcatagagaagattgctaagggtgaagaaaggtggaagagatgcaatgaacacctggtaccaatcctgacctatacagcaaaaggacttgaagaggggaaagagtaccaattccgtgtgcgagcagagaacgccgcgggtattagtgaaccttctcgggctactcctccaaccaaagctgtagatcccattgatgcccccaaagtcattctgagaacaagcctagaagtgaaacgaggtgatgaaatagcacttgatgcaagtatttctggatcaccttacccaactattacatggataaaggatgaaaatgttattgtaccagaggaaattaagaagcgtgcagcacccttggttaggagaaggaagggtgaagttcaagaagaagaaccatttgtcctgcctctgacacagcgtttgagtattgacaacagcaaaaagggagaatctcagctacgcgtccgagattctctccgacctgaccatggtctgtatatgatcaaagttgaaaatgaccacggtattgcaaaagctccttgtactgtcagtgtgttagatacaccgggaccaccaatcaactttgtatttgaagatatcagaaagacctcagtcctttgtaaatgggaaccaccccttgatgatggtggcagtgaaatcataaactacactttggaaaagaaagacaagacaaaacccgactcagaatggattgttgtcacttcaacacttagacattgcaaatattcagtaacaaaactgattgaaggaaaagagtacctcttccgtgtaagagctgaaaacagatttgggccaggtccaccatgtgtttcaaagccacttgtggctaaagatccatttggaccacctgatgcaccagataagcccattgtggaagatgttaccagcaacagtatgctagtgaaatggaatgaaccaaaagataatggaagccccattttgggttactggcttgaaaaacgtgaagttaacagtacacattggtctcgtgtcaacaaaagccttctgaatgccttgaaagccaatgtagatggcttattagaaggactcacctatgtcttcagagtatgtgctgaaaatgcagctggacctggaaagttcagtccaccttcagatcccaaaacagcacatgatccaatctctcctcctgggccacctatcccaagagtcactgacacaagctctacaactattgaactagaatgggaacccccagctttcaatggtggtggggaaattgttggctattttgttgataagcagttggttggcacaaatgaatggtcacgctgcacagagaagatgatcaaggtccgtcagtacaccgtcaaagaaatccgagagggtgctgattacaaacttcgggtgagtgctgtcaatgccgcaggggaaggaccgcctggagaaacacaacctgttactgtggctgaaccacaagagcctccagctgtggaactggatgtttctgtcaagggtggaatacaaataatggctgggaagactcttagaattccagctgtggtgactggtcgccctgtacctacaaaagtatggaccaaagaagaaggggagctggataaagaccgtgttgtaatagacaacgttggaaccaaatctgaactaattatcaaggatgcactgcgaaaagaccatggcagatatgtgattacagctacaaatagctgtggttccaaatttgcagcagccagggtagaagtttttgatgtccctggtccagttcttgacttaaaacctgttgtaacaaacagaaaaatgtgtctacttaactggtctgatccagaagatgatggaggaagtgaaataacaggctttatcattgaaagaaaagatgccaagatgcatacttggagacaaccaatagagactgagagatctaaatgtgacatcacaggtctgcttgagggacaagaatataagttccgtgttattgccaagaacaagtttggctgtggccctcctgttgaaataggaccaattcttgcagttgatccactaggtcctccaacatctccagagaggctcacatacactgaaaggacaaagtccactatcacacttgactggaaagagccccgcagtaatggtggcagtcccatccaaggatatatcattgaaaaacggcgtcatgacaaacctgactttgaaagagttaacaagcgactctgcccaaccacatcttttctggttgaaaatcttgatgaacaccaaatgtatgagttccgtgtcaaagctgtcaatgaaattggtgaaagtgaaccatccctacctcttaatgtagtcatacaagatgatgaagtgcctccaactattaagttgcgtctgagtgttcgaggagacactatcaaagttaaggcaggagagcctgtccacatccctgcagatgtgacaggccttccaatgcctaagattgaatggtccaaaaatgaaactgtaattgaaaaacccactgatgcacttcagataaccaaggaagaggtatcccgaagtgaggcaaaaactgagcttagcattcccaaagcggtccgggaggacaaaggcacttacacagttactgcttccaatcgccttggctcagtgttccgaaatgttcacgttgaagtatatgaccgcccatccccaccaagaaatcttgctgttactgacattaaagctgaatcttgctacttgacatgggatgcccctcttgataatggtggcagtgaaatcacccattatgttattgacaaacgtgatgcaagtaggaagaaagcagaatgggaggaagtcaccaacactgctgtagagaaaagatatgggatctggaaacttatccccaatggtcagtatgagttccgagtcagggcagtgaataaatatggaatcagtgatgagtgcaaatcagataaagtagtcattcaagatccttatcgccttcctggacctccaggaaaaccaaaagttttggcacgcaccaaaggatcaatgctagtgagctggactcctcctttggacaatggtggctctccaattactggctactggctggagaaaagagaagagggaagtccttattggtcacgtgttagccgagcaccaataaccaaagtgggattgaaaggcgtggaatttaatgttcctcgtttgcttgaaggcgttaaataccagttcagagccatggcaataaatgctgcaggaattggtcctcccagtgaaccatcagatccagaggttgcaggagatcccatatttccaccggggccaccttcttgcccagaagttaaagataaaacgaagtcaagcatctcactaggatggaaacctccagccaaagatggtggcagcccaatcaaaggatacattgtagaaatgcaagaagaaggtactactgactggaaaagagtaaatgaaccagacaaacttataactacctgtgaatgtgtggtgcctaatctgaaagagctcaggaagtacagattcagagtgaaagctgtcaatgaagctggtgaatctgaaccaagtgatacaactggggagatccctgccactgatattcaagaggaaccagaagttttcattgacattggagcacaggactgtctggtttgtaaagctggctcacagattaggattcctgctgtcatcaagggacgcccaacaccaaaatcatcttgggaatttgatggaaaggcaaagaaagcaatgaaggatggagttcatgacatacccgaagatgcacagctggagactgctgaaaactcctcagtaattattattccggagtgtaaacgatctcatacaggcaaatacagcatcacagccaagaataaagcaggacaaaagactgcaaattgcagagttaaagtcatggatgtaccaggcccacccaaagatctgaaagtcagtgatatcacaaggggtagttgcagactttcatggaagatgccagacgacgatggaggagacaggatcaaaggctatgttattgagaagaggactattgatggaaaagcctggaccaaagtcaatccagactgtggaagcaccacatttgtagtgcctgatctcctctctgaacagcaatatttcttccgtgtgcgagcagaaaaccgttttggtattggcccacctgtggaaaccattcagaggaccactgccagagatccgatatatcctcctgatcctcctattaaactcaagattggcctcatcacaaagaacacagtgcatctgtcatggaaacccccgaagaatgatgggggctcccctgttacccactatattgttgagtgccttgcatgggaccctactgggacaaagaaagaagcctggaggcagtgcaataagcgtgatgtggaagaactgcaatttactgttgaagacctagtagaaggtggggaatatgaattccgagtcaaagctgtcaatgctgcaggagtcagcaagccttcagccactgttgggccctgtgactgtcaaagaccagacatgccaccatcaattgatctaaaagaattcatggaggttgaagaaggaaccaatgttaacattgtggccaaaattaaaggtgtgccattcccgacactaacctggtttaaagctcctccaaagaagcctgataacaaagaacctgttctctatgacacccatgtcaacaaactggtggtagatgatacttgcactttagttattccgcagtctcgcaggagtgacactggcttatataccatcacagctgtaaataatctgggaacagcatcaaaggagatgagactgaatgtcctgggtcgtcctggccctccagtgggacccataaaatttgaatctgtttcagcagatcaaatgacactatcttggtttccacctaaagatgatggtgggtctaagattacaaactatgtaattgagaaaagagaagctaacaggaagacatgggtccatgtctccagtgaacctaaggagtgcacgtacacgattcccaaattgctagaaggccatgaatatgtattccgaatcatggcccagaataaatatggcattggagaacctcttgacagtgaacctgaaacagcaagaaacctcttctctgtccctggagcaccagataaaccaacagttagcagcgtgactcgtaactccatgactgtcaactgggaagagccagaatatgatggaggctctcctgtgacagggtactggctggaaatgaaagacaccacttcaaagagatggaagagagttaaccgagatcctatcaaagccatgactttgggtgtttcttataaagtgactggtcttattgaaggttccgactatcaattccgggtatatgcaatcaatgctgctggcgtgggtccagcaagtctgccatcagacccagcgactgctagagatccaattgcccctcctggtcctccatttcccaaagtgacagattggactaaatcatctgcagatctggagtggtctcccccactaaaagatggtggatccaaagtaactggatacatcgttgaatataaagaagaaggaaaagaagaatgggaaaagggtaaagataaagaagtgagaggaacaaagctcgttgtgacaggattaaaggaaggagcattctacaaatttagagttagtgcagtcaacattgctggcattggagaacctggagaggtcacagatgtcattgaaatgaaggacagacttgtttcacctgaccttcagctagatgccagtgtcagagatagaattgttgtccatgctggaggggtgatccgaatcattgcctatgtgtctggaaagcctcctccaaccgtcacctggaacatgaatgaaagaaccttacctcaagaagccaccattgagaccacagccattagctcatccatggtcatcaagaactgccagaggagccatcaaggcgtctattctcttcttgccaaaaatgaagccggagaaagaaagaagacaattattgttgatgtattagatgttccaggtcccgttggaacaccattcctagctcacaacctaaccaatgagtcctgcaaactgacatggttttctccagaagatgatggaggctctccaatcaccaattatgtcattgaaaagcgtgaatctgaccgcagagcatggaccccagtgacatatacagttacccgacaaaatgctactgtccagggtctcattcaaggaaaagcctactttttccgaattgcggctgaaaatagtattggcatgggtccatttgttgagacatcagaggcacttgttatcagagagccaataactgtaccagagcgtcctgaagacctggaagtcaaagaagttactaaaaatactgtaactttgacttggaatcctcctaagtatgatggtgggtcagaaattattaactatgtcctagaaagtcggctcattgggactgagaagttccacaaagttacaaatgacaacttgcttagcagaaaatacactgttaaaggcttaaaagaaggtgatacctatgagtaccgtgtcagtgctgtcaacattgttggacaaggcaaaccatcattttgcaccaaaccaattacttgcaaggatgagctggcacccccaacgcttcacctcgacttcagagataagctcacgattcgagttggtgaagcttttgccctcactggccgttactcaggcaaaccaaagcctaaggtttcctggttcaaagatgaagctgatgtgctggaagatgatcgcactcatataaagactacaccagcaacacttgctttagagaagatcaaggccaaacgttcagattccggcaaatactgtgtggttgtggagaacagtacaggctctaggaaaggtttctgtcaagttaatgttgttgaccgtcctggaccaccagtaggaccagttagttttgatgaggtgaccaaagattacatggttatctcttggaagcctcctttagatgatggaggcagtaaaatcaccaattatattattgagaagaaggaagtgggtaaagacgtctggatgccagtgacatctgcaagtgctaaaacaacatgcaaagtttctaaactacttgaaggaaaagattatattttccggatacatgctgaaaatctgtatggaataagtgatcctctggtgtctgattcaatgaaagccaaagatcgtttcagggttcctgatgcacctgatcagccaattgttacagaagttaccaaagactctgcattagtaacctggaataagccacatgatggaggaaaacccatcacaaactacatcctggaaaagagagaaactatgtctaaacgatgggctagagttaccaaagatcctattcatccatacactaaatttagggttcctgatcttctagaaggatgtcagtatgaattccgggtttctgcagaaaatgaaattggtattggagatccaagcccaccatccaaaccagtctttgctaaagatccaattgctaaaccaagtccacctgttaatcctgaagcaatagatacaacatgcaattcagtcgatctaacttggcagccaccacgtcatgatggtgggagcaagattctgggttatattgttgagtaccagaaagttggagatgaagagtggagaagagccaatcacacccctgagtcatgtcctgaaactaaatataaagtcaccggtcttcgggacggtcaaacctataagtttagagtgttagcagtcaatgcagctggtgaatcagatccagctcatgttccggagccagtcctagtaaaagacaggcttgaaccccctgagttgattcttgatgccaacatggcaagagaacaacacattaaagttggtgatactctaagacttagtgccatcatcaaaggagtgccattcccaaaagtaacttggaaaaaagaagacagagatgctccaactaaagcaagaattgatgtgactccagttggtagcaagcttgaaattcgtaatgctgcccatgaagatggtggaatttattctttaacagtggagaatccagctggttcaaaaactgtctcagtaaaagtacttgtattagataaacctgggccacctagagatctggaagtcagtgaaattaggaaagattcatgttaccttacttggaaagaaccactggatgatggtggttctgttattaccaattatgtggttgagaggagagatgttgccagcgcccagtggtcacctctctcagctacatcaaagaaaaagagtcacttcgctaagcatctgaatgaaggcaaccagtacctcttccgagtagctgcggagaaccagtatggacgtggtccttttgttgaaacaccaaaaccaatcaaggctttggatcctctccatcccccagggccacccaaggacctgcaccatgtagatgttgacaagactgaagtctccctagtctggaataagccggatcgtgatggtggttctccaatcactggatatttggtagaatatcaagaagaaggcacccaggactggattaaatttaagactgtgacaaacttagagtgtgtggttactggactacaacaaggaaagacctatagattccgtgtaaaagctgaaaacattgtgggtcttggtctccctgacacaactatcccgatagaatgtcaagaaaaactagtgcctccatccgtggagctagatgtgaaattaattgaaggtcttgtggtaaaggctggaaccacagtcagattccctgctattataagaggtgtgcctgttcctactgcaaagtggacaaccgatgggagtgagattaaaaccgatgagcactacacagttgaaacagacaacttctcatcagtacttaccattaagaactgcttaaggagagacactggggaatatcaaatcacagtttccaatgcagccggtagcaaaacagtagccgtacatcttactgttcttgatgttcctgggccaccaacaggtcctattaatattctggatgttactcctgaacacatgactatctcatggcagccacctaaggatgatggaggaagccctgtgataaattatattgttgagaaacaagatacaaggaaagacacgtggggtgttgtctcttccggaagcagtaagacaaagctgaaaatcccacatctgcagaagggctgtgaatatgttttccgagttagagcagagaataagataggtgttggtcctccccttgactccacacctactgttgctaagcataaatttagtcctccgtctcctcctggtaaaccagtggttactgacattactgaaaatgcagcaacagtgtcttggaccctgccaaaatctgatggtggcagtccaataactggctactatatggaacgtcgagaagtaactggcaaatgggtgagggtcaacaaaacacctatcgctgacctgaagttcagagtgactggactctatgaaggaaatacatatgagtttagagtttttgctgaaaatcttgcaggactaagcaaaccatccccaagttctgatccaataaaagcttgccggcccatcaaaccacctggaccacctattaatcctaaactgaaagacaagagcagagaaacagctgatttggtgtggacaaagcctctcagtgatggtggtagccccattctaggatatgtagtggaatgtcagaaacctggcacggcacaatggaacaggattaataaagatgaactcattaggcaatgtgcctttagggtacctggactaattgaaggaaatgagtacagattccgtataaaggcagctaatattgtaggagagggtgagccaagagaactagcagaatctgtgattgcaaaagatatccttcatcctccagaagtagaacttgatgttacttgtcgtgatgttattaccgtgagagtaggccaaactatccgcattctagctcgagtcaaaggcagacctgaaccagacataacttggactaaggaaggcaaagtattggtccgagaaaagagggtggaccttattcaggatctacctcgtgttgagttacaaattaaagaagctgttagagctgatcatggcaagtatatcatctcagctaagaacagcagtggacatgcccaaggttcagccatcgttaacgtccttgacagacctgggccttgccagaatttgaaggttaccaatgtaaccaaagagaactgtacaatttcttgggaaaacccactagataatggtggctcagaaataacaaacttcatagtagaatatcgcaaaccaaaccagaaaggctggtcaattgttgcatcagatgtcactaaacgattaatcaaggccaaccttttagccaacaatgaatactatttccgagtttgtgcagagaataaagtaggtgttgggccaaccatcgaaacaaaaactcccattctggctattaaccctattgacagaccaggtgagcctgaaaaccttcacattgcagataaaggaaagacatttgtctatctaaagtggcggaggcctgactatgatggtggcagtccaaatctgtcatatcatgttgagagaaggcttaagggctccgatgactgggaaagagtgcataaaggaagcattaaagaaactcactacatggttgacagatgtgttgaaaaccagatttatgagttcagagtgcaaacaaagaatgaaggtggggaaagtgactgggtgaagacagaggaagttgttgtgaaagaagacttacaaaaaccagtacttgatctgaaattaagtggggtcctaactgtcaaagcaggggacaccattaggcttgaggcaggggttagaggcaaaccattcccagaagttgcatggaccaaggacaaagacgctacagacttaacaagatcaccaagggtcaagattgatacccgtgctgattcatctaaattttctcttactaaagcaaagcgaagtgatgggggtaaatatgtagttacggcaactaacacggctggcagttttgtggcctatgccactgtcaatgttttagataagcctggtcctgtgagaaatctgaaaattgttgatgtgtccagtgataggtgtactgtttgctgggatccaccagaagatgatggtggctgtgaaatccaaaattatattctagaaaaatgtgagacaaagcgaatggtttggtctacctattctgctactgtcttgacacctggtactacagtaacacgtctcatagaaggaaatgaatatattttcagagtccgtgcagaaaataaaataggcacagggcctccaacagaaagtaaaccagtcatagccaaaaccaagtatgataaacctggtcgccctgatcccccagaagtcactaaagtaagcaaagaagagatgactgtggtttggaatccacctgaatatgatggtggaaagtctataactggatactttttggagaaaaaggaaaagcattcaacacgatgggtccctgtcaacaagagtgcaatccctgagagacgtatgaaagtacagaatctcctcccagaccatgaatatcagttccgtgtcaaggcagaaaatgaaattggaattggagaaccaagcttgccttcaagaccggtggtggcaaaagaccccatagagccacctggtccaccaaccaatttcagagtggttgatacaaccaaacattccataactcttgggtggggaaaaccagtctatgatggtggtgcaccgatcattggatatgttgtggaaatgagaccaaaaatagcagatgcgtctcctgatgaaggctggaaacggtgtaatgctgcagcacagcttgtacgcaaggaattcactgttaccagcttggatgaaaaccaggaatatgagttcagggtgtgtgcccaaaaccaagttggtattgggcgccctgcagagctaaaggaagctatcaaacctaaagaaatactagaacctccggagattgatttggatgccagcatgaggaaactggtcatagtgagagcaggatgccctattcgtctctttgctatagtgagaggacgaccagcccctaaagtcacttggcgaaaagttggcattgataatgtggtcagaaaaggacaagttgatctggttgacactatggccttccttgtcatccccaattctacccgtgatgactcaggaaaatattccttaacacttgtgaacccagcaggagaaaaggctgtattcgtaaatgtcagagtattagacactcctgggcctgtgtctgatttaaaagtttcagatgtcactaaaacatcatgccatgtgtcctgggcccctcctgaaaacgacggtgggagccaagtgacacattatatcgtggagaaacgtgaggcagacagaaagacatggtcgaccgttaccccagaagttaagaaaacaagcttccatgtaaccaatcttgtccctgggaatgagtattacttcagagtaactgctgtcaacgaatatggccctggcgtcccaacagatgtcccaaaaccagtgcttgcatcagatcctctaagtgagccggatcccccaaggaaattagaagtgactgaaatgaccaagaacagtgccaccttagcctggttacctcccctacgtgatggaggtgctaaaatcgatggctacatcactagttacagagaagaagagcagcctgcagatcgctggacagagtactcagtggtaaaagatctgagccttgttgtcactggcctaaaggaaggaaagaaatacaaatttagagtagcggccagaaatgctgttggagtcagtttgccaagagaagctgaaggagtgtatgaagccaaagaacaactgttgccaccaaagatccttatgccagagcaaataactatcaaagctgggaaaaaactccgaattgaagcccatgtgtatggaaagcctcatcccacctgtaaatggaaaaaaggagaagatgaagttgtcacatccagccacctggcagtgcataaagcagacagctcttcaattctgatcataaaagatgtgactaggaaagacagtggttactacagcctcacagcagagaacagttctgggacagacactcagaaaatcaaagttgtagtcatggatgcccccggcccccctcagcctccatttgacatttctgatatagacgctgatgcttgctccctgtcatggcacatccctctggaggacggaggcagtaacatcaccaattatatagtggagaagtgtgatgtaagccgaggtgactgggtcacggctctagcttcagtcacaaaaacttcctgcagggttggaaagctgatcccaggccaggagtacatcttccgggtccgtgctgaaaaccgatttggcatttcagagcctctcacatctccaaagatggttgcgcagttcccatttggtgttcctagtgaaccaaagaatgcacgagtcaccaaagtcaacaaggactgtatttttgttgcttgggacagaccagatagtgatggagggagccccattattggttatctgattgaacgcaaggaaagaaacagtttgctgtgggtgaaagccaatgatactcttgtccggtcaactgaatatccttgtgctggccttgtagaaggtcttgagtattcattcagaatctatgccctaaacaaagctggatccagcccacccagcaaacccacagaatatgtaactgcaagaatgccagttgatcctcctgggaaacctgaggttattgatgtcaccaagagtactgtatctctgatctgggctcgtccaaagcatgatggaggcagtaaaattattggctatttcgtagaagcttgcaaacttcctggtgataaatgggtacggtgcaatactgcacctcaccagattccccaggaagagtacacagctactggcctagaagagaaagctcagtatcaatttagagctattgccaggaccgcggtaaacattagcccaccttctgaaccttctgatccagtgactatcctcgcagaaaatgtccctcccaggatagacctgagtgtggctatgaaatctttgcttactgtgaaagctggaactaatgtctgcttggatgctactgtttttggtaaaccgatgccaacagtttcttggaaaaaagatggcacactgctaaaaccagcagaaggcataaagatggccatgcagcggaatctgtgcaccttggagctattcagcgtgaaccggaaggactcaggagactataccattactgctgaaaattcaagtggttctaaatcagccaccattaagcttaaagtgttagataaaccgggtcctccagcatctgttaaaatcaacaaaatgtattcagatcgtgctatgctttcttgggaaccgcctcttgaagatggaggctcagaaatcaccaactatattgttgacaaacgtgaaacaagcaggcccaactgggctcaagtctctgcaactgtgcctatcaccagctgcagcgtggagaaacttatagagggccatgagtatcagttccgtatttgtgctgaaaataaatatggagtaggcgatccagtcttcactgaaccagcaattgccaaaaacccatatgacccaccaggacgctgtgatcctcctgttattagcaacataaccaaagatcacatgacagtcagctggaagccaccagcagatgatgggggctcacccatcactggctatttgcttgaaaagcgggaaacccaggctgttaactggactaaggtcaacagaaaacctattatagaaagaacattaaaagcaacaggtcttcaagaaggtaccgaatatgagttccgtgttacagctataaataaagctggaccaggcaaacccagtgacgcatccaaggccgcttatgctcgggaccctcagtatcctcctgcgccaccggctttccctaaagtatatgatacaactcgcagctctgtgagtctatcttggggcaagccagcctatgacggcggcagccctatcattggttatctcgttgaagtaaaacgggctgactccgataactgggtgaggtgcaacttaccacagaatctacagaaaacccgctttgaggttactggcctgatggaagacacacaatatcaattccgtgtgtatgccgttaataagattggatacagtgaccccagtgatgtgccagataaacactatcccaaggacatcttaattccacctgagggagaacttgatgcggacttaaggaagacactcatattacgtgctggagttactatgagactatatgtaccagtaaaaggacgcccacctccaaagattacttggtctaaaccaaatgtcaatctaagagacaggattggactggacataaagtcaactgactttgacactttcttgcgctgtgaaaatgtgaacaaatatgatgcaggaaaatatatcttaaccctggagaacagctgtggtaaaaaggaatataccattgttgtgaaagtgcttgatactcctgggccacctgtcaatgtgactgttaaggaaatatccaaagactctgcttatgttacctgggagcctcccattattgatggcggaagccccatcataaactatgtggtacaaaaacgtgatgcagagaggaaatcctggtctacagtgacaactgagtgctccaaaacaagcttcagagtagctaatttggaggagggaaaatcctacttcttccgagtgtttgctgaaaatgagtatggcattggtgatcccggtgaaactcgtgatgctgtcaaagcttcccaaactcctggaccagttgtggacctgaaagtgaggtctgtatctaagtcatcctgtagcattggctggaaaaagcctcacagtgatggtggaagtcggattattggatatgtagttgatttcctgactgaagaaaataagtggcaacgagttatgaaatccttaagcctacagtactctgcaaaagatttgactgaagggaaggaatataccttcagagtgagtgctgagaatgaaaatggagaaggaaccccaagcgaaatcactgttgtggcaagggatgatgttgtggctcctgatcttgacttaaagggtctacctgatttgtgctacttggctaaagaaaacagcaacttccggcttaagatccccataaaaggcaagccagctccatcagtctcctggaagaaaggggaagatcctctagcaactgacactagagtcagtgttgagtcatctgcggttaacacaactcttatagtgtacgattgccaaaaatctgatgctggaaaatacacaatcacacttaagaatgttgctggcaccaaggaaggaactatctccataaaggttgttggcaagcctggcatccccactggaccaatcaaatttgatgaagtcacagcagaagccatgaccttaaagtgggctcctccaaaggatgatggaggttctgaaatcaccaactatatcctagagaagagggattctgtgaacaacaagtgggtgacgtgcgcctcagctgtccagaaaaccacctttagagtaaccagacttcatgagggcatggaatataccttcagggtcagtgccgaaaataaatatggtgtaggggaaggcctgaaatcggagccaattgttgcgagacatccatttgatgtgcctgatgctcccccacctcccaatattgtggatgtcagacacgattcagtatctctaacttggactgaccccaagaaaactggtggttctccaattacagggtatcatctcgagttcaaggaaagaaacagccttttgtggaagagagctaacaagactccgataaggatgagagactttaaagtgacaggattaactgaaggtcttgaatatgaattccgagttatggcaatcaatttagcaggtgtgggcaagccaagcctaccatcagagcctgttgtggcactggacccaattgatcctcctggaaaacctgaggttattaacataacaaggaattcagtgactctcatttggactgaacctaaatatgacggtggtcataagttaactggatatatagtggagaagcgagatctaccttcgaagtcttggatgaaagccaaccatgttaatgtcccagaatgtgcctttactgtaactgaccttgttgagggtggaaaatatgaattcagaattagagcaaagaatacagcaggtgctatcagtgctccatcagaaagtacagaaaccattatttgcaaggatgaatacgaggcaccaacaattgtccttgatcccacaataaaagatgggctaacaattaaagcaggggataccattgttttgaatgccattagcattcttggcaaaccccttccaaaatcaagttggtccaaggcaggaaaagacattagaccatcagatatcactcagataacttcaaccccaacatcttccatgcttactatcaagtatgccactagaaaagatgcgggtgaatataccatcactgctaccaatccttttggcacgaaggtggaacatgtgaaggtaacagtccttgatgtacctggtcccccaggtcctgttgaaatcagtaatgtttctgctgaaaaagcaacacttacatggacacctcccttggaagatggcggctcaccaattaagtcctatatacttgaaaagagagaaaccagccgacttttgtggacagtggtttctgaagatattcagtcttgcaggcatgtggcaaccaaacttatccaaggaaatgagtacatcttccgggtctcagctgtaaaccactatggcaaaggagaacctgtacagtctgaacctgtcaaaatggtagacagatttggtccccctggccctcctgaaaaaccagaggtatcaaatgtcactaagaacactgccactgtcagctggaaaaggccagtggatgatggtggcagcgaaattacaggatatcatgtagaaaggagagaaaagaaaagcctgcgatgggtgagagcaataaaaacaccagtttccgatctcaggtgcaaagtaacaggactgcaagaaggaagcacctacgaattccgtgtcagtgcagaaaacagagcaggaattggtccacccagtgaggcttcagattctgttctgatgaaagatgcagcatatcctccaggaccaccttcaaatccgcatgtcactgatactaccaagaaatctgcttctttggcatggggcaagcctcattatgatggtggacttgaaatcactggctatgtcgtggagcatcaaaaagtaggagacgaggcctggataaaagataccacaggaaccgccctcagaatcactcagttcgttgttcctgatcttcagactaaagaaaaatacaacttcagaatcagtgccatcaacgatgcaggtgttggggagccagcggtgattccagatgttgaaatcgtagaacgggagatggctcctgattttgaactagatgccgagcttcgaagaacacttgttgttagagcaggactcagtattaggatatttgtgccaattaaaggtcgtcctgctcctgaagtgacatggaccaaagataacatcaacctgaaaaaccgagccaacattgaaaatacggaatcatttactcttctgattatcccagaatgtaacagatatgataccggtaaatttgtcatgaccattgaaaacccggctgggaagaaaagtggctttgtgaacgtcagagtcttggacacgccaggcccagtcctcaacctgcggcctacagacatcacaaaggacagtgtcaccctgcactgggacctccctctgatagatggaggctcacgtataacaaactacattgtagagaaacgtgaagcaacacggaaatcttattccacagccaccactaagtgccataaatgcacatataaagttaccggcttgtctgaagggtgtgaatatttcttcagagtgatggcagagaatgaatatggaattggtgagccaacagaaactacagagcccgtaaaagcctctgaagcaccatctccaccagacagccttaacatcatggacataactaagagcaccgtcagcctggcatggcctaagcccaaacacgatggtggcagcaagatcactggctatgtgattgaagcccaaagaaaaggctctgaccagtggacccacatcacaaccgtgaaagggttagaatgtgttgtgaggaatctaactgaaggagaggaatataccttccaagtgatggcagtgaacagcgcggggagaagtgcccctagagaaagcagacccgtcattgtcaaggagcagacaatgcttccagagctggatctccgtggcatctatcagaaactggtcattgccaaagctggtgacaacatcaaagttgaaattccagtgctcggtcgaccgaagcccacagtgacatggaaaaaaggagaccaaattcttaaacagacacagagagttaattttgaaaccacagcgacttcaaccattttaaatatcaatgagtgtgtcagaagtgatagtgggccctatccattaacagcaaggaacattgtaggagaggttggtgatgtcatcaccattcaagtccatgatatcccagggccacctactggaccaatcaaatttgatgaagtttcatctgattttgtaaccttctcttgggacccacctgagaacgatggtggtgtaccaataagcaactatgtagtggaaatgcggcagactgacagtactacctgggttgagttagcaaccaccgttatacgtactacctataaagccacccgccttactactggattagagtatcagttccgtgtaaaagctcagaatagatatggagttggaccaggcatcacatcagcatgcatagttgccaactatccatttaaggttcctggacctcctggtacccctcaggtaactgcagttaccaaggattcaatgacaattagctggcatgagccactttctgatggtggaagccccattttaggatatcatgttgaaagaaaagaacgaaatggtattctctggcagactgtgagcaaagctttagtaccaggcaacattttcaaatcaagtggacttacagatggtattgcttatgagttccgggtgattgcagaaaacatggcaggcaaaagtaagccaagcaagccatcagaacctatgttggctctggatcccattgacccacctggaaaaccagtacctctaaatattacaagacacacagtaacacttaaatgggctaagcctgaatatactgggggctttaaaattaccagttatatcgttgaaaagagagaccttcctaatggacggtggctgaaggccaacttcagcaacattttggagaatgaatttacagtcagtggcctaacagaagatgctgcatatgaattccgtgtgatcgccaaaaatgctgcaggtgccatcagtccaccatctgagccatctgatgctatcacttgcagggatgatgttgaggcaccaaagataaaggtggatgttaaatttaaggacacggttatattaaaagcaggtgaagcattcagactggaagctgatgtttcaggccgcccacctccaacaatggaatggagcaaagatggaaaagagctggaaggcacagcaaagttagaaataaaaattgcagatttctctactaatctggtaaacaaagattcaacaagaagggatagtggtgcctatacccttacagcgactaatcctggtggctttgctaaacacattttcaatgtcaaagttcttgacagaccaggcccacctgaaggacctttggctgtaactgaagtgacatcagaaaagtgtgtactatcatggttccctccactggatgatggaggtgccaaaattgatcattacatagtacagaaacgtgaaaccagcagattggcatggacaaatgtagcctcagaagtccaagtaacaaagctaaaggtcactaaactcttgaaaggcaatgaatacatattccgtgtcatggctgtaaataaatatggagtgggagagccactggaatcagagcctgtgcttgcagtgaatccttatggaccccctgatccgcccaaaaaccctgaagtgacaactattactaaagattcgatggttgtctgctggggacatcctgattctgatggtggaagtgaaatcatcaattatattgtggaacggcgtgataaagctggccaacgctggattaaatgcaacaaaaaaactcttactgatttaagatataaagtgtctggactgacagaaggacatgaatatgagttcaggattatggctgaaaatgctgctggaattagtgcaccaagtcctaccagtccattttacaaggcttgtgacactgtgtttaaacctggaccaccaggtaacccacgtgttctggatacaagcagatcatccatttcaatcgcttggaataaacctatctatgatggtggttcagaaatcactgggtatatggttgagattgccctgccagaggaagatgaatggcagattgtcactccaccagcaggactcaaggcaacttcgtatactatcactggcctcacagagaatcaggaatataagatccgcatctatgccatgaattccgaaggacttggggaacctgcccttgttcctggaactccaaaggctgaagacagaatgctgcctccagaaattgaactggatgctgacctgcgcaaagttgttactataagggcctgctgcaccctgagactttttgttcccatcaaaggaaggcctgcacctgaggtgaagtgggcccgggaccatggagaatctttagataaagctagcatcgaatccacaagctcttacaccctgcttattgttggaaatgtaaacagatttgacagtggcaaatatatactaactgtagaaaatagttcaggcagcaagtctgcatttgtcaatgttagagttctcgatacaccaggccccccacaggatctgaaggtaaaagaggtcactaagacatctgtcacactcacatgggacccacctctccttgatggaggttcaaaaatcaagaactatattgttgaaaagcgggaatcaacaagaaaagcatattcaactgttgcaacaaactgccacaagacttcctggaaggtagaccagcttcaagaaggctgtagctactatttcagggttctcgcagaaaatgaatatggcattgggctgcctgctgaaaccgcagaatctgtgaaagcatcagaacgacctcttcctccaggaaaaataactttgatggatgtcacaagaaatagtgtgtcactctcttgggagaaaccagagcatgatggaggcagccgaattctaggctacattgtggagatgcagaccaaaggcagtgacaaatgggccacgtgtgccacagtcaaggtcactgaagccactatcactggattaattcagggtgaagaatactctttccgtgtttcagctcagaatgaaaagggcatcagtgatcctagacaactgagtgtgccagtgatcgccaaagatcttgtcattccaccagccttcaaactcctgttcaatactttcactgtactggcaggtgaagacctaaaagttgatgttccattcattggccgccctaccccagctgtaacctggcataaagataatgtaccactgaagcagacaactagagtaaatgcagagagcacagaaaataattcactactgacaataaaggacgcctgccgagaagatgttggccattatgtggttaaactgactaactcagctggtgaagctattgaaacccttaatgttatcgttcttgacaaaccagggcctccaactggaccagttaaaatggatgaagtgacagctgatagtattactctttcctggggcccacccaagtatgatggtggaagttctatcaataattacattgttgagaaacgggacacttccacaaccacctggcaaattgtatcagctacagttgcaaggacaacaataaaggcttgcagactgaagactggatgtgaatatcagtttagaattgcagctgaaaacagatatgggaagagtacctacctcaattcagagcctactgtagcccaatatccattcaaagttcctggtcctcctggcactccagttgtcacactgtcctccagggacagcatggaagtacaatggaatgagccaatcagtgatggaggaagtagagtcattggctatcatctagaacgcaaggaaagaaatagcatcctctgggttaagttgaataaaacacctattcctcaaaccaagtttaagacaactggccttgaagaaggtgttgaatatgaatttagagtctctgcagagaacatcgtgggcattggcaagccgagtaaagtatcagaatgttatgtggctcgtgacccatgtgatccaccaggacggccagaggcaatcattgtcacaaggaattctgtgactcttcagtggaagaaacccacctatgacggtggaagcaagatcactggttatattgttgagaagaaagaattacctgagggccgttggatgaaagccagttttacaaatattattgacactcattttgaagtaactggcctagttgaagatcacagatatgagttccgggttatagcccgaaatgccgcaggagtgtttagtgagccttcagaaagcacaggagcaataacagctagagatgaggtagatccaccacgaataagtatggatccaaaatacaaagacacaatcgtggttcatgctggtgaatcattcaaggttgatgcagatatttatggcaaaccaataccaaccattcagtggataaaaggtgatcaggagctttcaaacacagctcgattagaaataaagagcaccgactttgccaccagtctcagtgtaaaagatgcagtacgtgtcgacagtggaaattacatactgaaggccaaaaatgttgcaggagaaagatcagttactgtgaatgtcaaggttcttgacagaccagggccacctgaaggacctgttgttatctcaggagttacagcagaaaaatgcacactagcttggaaacccccacttcaggatggtgggagtgacatcataaattatattgtggaaaggagagaaaccagccgcttagtttggactgtggttgatgccaatgtgcagactctcagctgcaaggttactaagcttcttgaaggcaatgaatatactttccgtataatggcagtaaacaaatatggtgttggtgaacctcttgaatctgagccagtagttgccaagaatccatttgtagtaccagatgcaccaaaagctccagaagtcacaacagtgaccaaggactcaatgattgttgtatgggaaagaccagcatctgatggtggtagtgaaattcttggatatgttcttgagaaacgggataaagaaggcattagatggacaagatgccataagcgtctgattggagagttgcgcctgagagtaactggactcatagaaaatcacgattatgagttcagagtttctgctgagaatgctgctggacttagtgaaccaagccctccttctgcttaccaaaaggcttgtgatcctatttataaaccaggacccccaaacaaccccaaagtcatagacataaccagatcttcagtattcctttcttggagcaaaccaatatatgatggtggctgtgaaattcaaggatacattgttgaaaaatgtgatgtgagtgttggtgaatggacaatgtgcactccaccaacaggaattaataaaacaaacatagaagtagagaagctgttggaaaagcatgaatacaacttccgtatctgtgctattaataaagctggagttggagaacatgctgacgtccctggacctattatagttgaagaaaaattagaagcaccagacattgatcttgacctagaactaaggaaaatcataaatataagggcaggtggctccttaaggttatttgttcctataaaaggtcgtcctacaccagaagttaaatggggaaaggtggatggtgaaatccgagatgcagctataattgatgtcactagcagtttcacctctcttgttcttgacaatgtcaaccgatatgatagtggaaaatatacgcttacattagaaaacagcagtggaacaaagtctgcctttgttactgtgagagttctggacacgccaagtccacctgttaacctgaaagtcacagaaatcaccaaagactcagtatcaattacatgggaacctcctttgttggatgggggatccaaaataaaaaattacattgttgagaaacgtgaagccacaagaaaatcatatgctgctgttgtaactaactgccataagaattcttggaaaatcgatcagctccaagaaggttgcagttattactttagagtcacagctgagaatgagtatggtattggccttcctgcccagactgctgatccaattaaggttgcagaagtgccacaacctcctggaaaaataactgtggatgatgtcaccagaaacagtgtctctctgagttggacaaaacctgaacatgatggtggcagtaaaatcattcagtatattgtggaaatgcaagctaaacacagtgagaaatggtcagagtgtgctcgagtaaagtctcttcaggcagtaattaccaacctaactcaaggggaagaatatctttttagagttgttgctgtaaatgaaaaggggagaagtgatcctcggtcccttgcagttccaatagttgccaaagatctggtaattgagccagatgtaaaacctgcattcagtagttacagtgtacaggttggccaagatttgaaaatagaagtgccaatttctggacgtcctaagccaaccattacctggactaaagatggtctcccactgaagcagaccacaagaatcaatgttaccgattcactggatctcaccacactcagtattaaagaaactcataaggatgatggtggacaatatggaatcacagttgccaatgttgttggtcagaagacagcatccatcgaaattgtaactctagataaacctgatcctccaaaaggacctgttaaatttgatgacgtcagtgctgaaagtattacattatcttggaaccctccattatatacagggggctgccaaatcaccaactacattgttcagaaaagagatacaaccaccacagtatgggatgttgtttctgctactgttgctagaactacactcaaagtgaccaaactgaaaactggtacagaataccaatttagaatatttgccgaaaacagatatggacaaagctttgccttagagtctgatccaattgtagctcaatatccctacaaagaaccaggccctccaggtacaccatttgccacagccatttccaaagactccatggtcatacagtggcatgaaccagtcaacaatggtggaagccccgtcataggttaccacctggagagaaaagaaagaaacagtattttgtggacaaaggtcaacaaaactattattcatgacacccaattcaaagcacagaatcttgaagaaggcattgaatatgaattcagagtgtatgctgaaaatattgttggtgtaggcaaagcaagcaagaattctgaatgctatgtagccagagatccctgtgacccaccaggaaccccagaaccaataatggttaaaagaaatgaaatcactttacagtggaccaaacctgtgtatgatggtggaagtatgattacaggctacattgtagagaaacgtgatttgcctgatggtcgttggatgaaagctagctttacaaatgtcattgaaactcaatttactgtgtcaggtcttactgaagatcaaagatatgaattcagagtcattgcaaagaatgcagctggtgcaataagtaaaccctctgacagtactggaccaataactgccaaggatgaggttgaactcccaagaatttcaatggatccaaaattcagagacacaattgtggtaaatgctggagaaacattcagacttgaggctgatgtccatggaaagcccctacctaccattgagtggttaagaggagataaggaaattgaagaatctgctagatgtgaaataaagaacacagatttcaaggctttacttattgtaaaagatgcaattagaattgatggtgggcagtatattttaagagcttccaatgttgcaggttctaagtcattcccagtaaatgtaaaagtattagatagaccaggacctccagaagggccagtccaggttactggagtcacttctgaaaaatgctctttaacatggtctccaccacttcaagatggtggcagtgacatttctcactatgttgttgaaaagcgagaaaccagtcgacttgcctggactgttgttgcttcagaagttgtgaccaattctctgaaagttaccaaactcttagaaggtaatgaatatgttttccgtataatggctgtcaacaaatatggtgttggagagcctttggaatctgcaccagtactaatgaaaaatccatttgtgcttcctggaccaccaaaaagcttggaagtcacaaatattgccaaagactccatgaccgtctgttggaaccgtccagatagtgatggtggaagtgagattattggttacattgtagagaaaagagacagaagtggcattcgatggataaaatgtaataaacgccgcattacagatttgcgtctaagagtgacaggattaacagaagatcatgagtatgaattcagggtctctgcagaaaatgctgctggagttggggaaccaagtccagctacagtttattataaagcctgtgatcctgtgttcaaacctggcccacctaccaatgcacacattgtagacaccactaaaaattcaatcacacttgcctggggtaaacccatctatgatggcggcagtgagatcttgggatatgtagtagaaatctgtaaagcagatgaagaagaatggcaaatagttactccacagactggcctgagagtcactcgatttgaaatttcaaaactcactgaacaccaagagtataaaatacgagtctgtgccctcaacaaagttggtttaggtgaggctacatcagttcctggtactgtgaaaccagaagataaacttgaagcacctgaacttgaccttgactccgaattaagaaaaggaattgttgtaagagctggtggatctgccagaattcacattccattcaaaggtcgtccaacgcctgagatcacttggtctcgagaggaaggtgaattcacagataaggtccaaattgaaaagggagtaaactatacccaactatcaatagataactgtgatagaaatgatgctggaaaatacattcttaagttggaaaacagcagtggatcaaagtctgcttttgtaactgtgaaagttcttgacactccaggaccaccacagaatttggcagtcaaagaagtgagaaaagattctgccttcctggtatgggagccacccatcattgatggaggggcaaaggtcaagaactatgtgattgacaaacgtgagtcaaccagaaaagcgtatgctaatgtgagtagtaaatgcagcaaaacaagttttaaagtggaaaaccttacagaaggagccatttattacttcagagtcatggctgaaaatgaatttggagttggtgttccagtggaaactgttgatgccgtgaaagctgctgaacctccttccccaccaggaaaggttacactcactgatgtgtcccagaccagtgcatcacttatgtgggagaaacctgaacatgatggcggtagcagagtcctggggtacgttgttgaaatgcagcccaaaggaactgaaaaatggagcattgtggctgaatccaaagtctgtaatgcagttgttactggtttgagttctggacaagaatatcagttccgtgtcaaggcttataatgagaaaggaaaaagcgatccaagagtgttgggtgttcctgtcatagccaaggacttgactatacagcctagtttaaagttaccatttaacacatatagtatccaagctggagaagatcttaaaatagaaattccagttataggccgaccaagacctaacatttcttgggtcaaagatggtgagcctcttaaacagacaacaagagtaaacgttgaagaaacagctacctcaactgttttgcacattaaagaaggtaacaaagatgactttggaaaatacaccgtaacggcaacaaatagtgcaggcacagcaacagaaaatctcagtgttatcgttttagaaaagcctggacctccagttggcccagttcggtttgatgaagttagtgcagactttgtagtcatatcttgggaacctccagcctatactggtggctgccaaataagcaactacattgtagagaagcgagatacaaccaccaccacttggcacatggtatcagcaacagttgcaagaacaacaattaaaataaccaaactgaaaacaggcacggagtaccagtttagaatttttgctgaaaacaggtatggaaaaagtgccccactggattctaaggcagttattgtacaatatccatttaaagaacctggaccacctggaactccttttgtgacatcaatctcaaaagatcagatgcttgtgcaatggcatgagccagtgaatgatggaggcaccaaaattattggctaccatcttgaacagaaagaaaagaacagtattttatgggtcaagttaaataagacccccattcaggacaccaaattcaaaacaactgggcttgatgagggccttgagtatgagttcaaagtttctgctgaaaatattgttggcattggcaagcctagcaaagtgtcagaatgctttgttgctcgtgatccatgtgacccacctggtcgccctgaagccattgttattacaagaaacaatgtcacactgaaatggaagaaacctgcctatgatggtggtagcaaaataacaggttatattgtagaaaagaaagatctacctgatggccgctggatgaaagccagctttaccaacgtattagaaactgaatttacagtgagtggacttgtagaagaccaaagatatgaatttagagtaattgcaagaaatgcagctggaaactttagtgaaccatctgatagtagtggtgccattactgcaagagatgaaattgatgcaccaaatgcctctctggatccaaaatataaagatgtcatcgttgttcatgcaggagagacttttgttcttgaagccgacatccgtggcaaacctatacctgatgttgtttggtcaaaagatggaaaagaacttgaagaaacagctgctagaatggaaattaaatctactattcagaaaacaactcttgttgtcaaagactgtatacggactgatggaggacaatatattctgaaactcagcaatgttggtggtacaaagtctatacccatcactgtaaaggtacttgacaggccagggcctcctgaagggcctctgaaagttactggagttactgcggaaaaatgttacctggcatggaacccacctttgcaagatggtggtgctaatatttcacattacatcattgaaaagagggagacaagccgactctcttggacccaggtttcaactgaggtacaggcccttaactacaaagttactaaacttcttcctggtaatgagtacattttccgtgtcatggctgtgaataaatatggaattggagagcccttggaatctgggcctgttacggcctgtaatccttataagccaccaggtcctccctcaacacctgaagtctcagcaatcaccaaagattctatggtagtaacatgggcacgcccagtagacgacggaggtaccgaaattgagggctacattcttgaaaaacgagataaggaaggcgttagatggaccaagtgcaacaagaaaacattaacggatctgcggctcagggtaactggtcttaccgaaggccattcctatgaattcagagttgctgctgaaaatgcagctggtgtgggagaacctagtgagccatctgttttctaccgtgcgtgtgatgccttgtatccaccaggtcccccaagcaatccaaaagtgacggacacttccagatcttctgtctccctggcatggagtaagccaatttatgatggtggcgcacctgttaaaggctatgttgtagaggtcaaagaagctgctgcggatgaatggacaacctgcactccaccaacaggattacaaggaaagcagttcacagtgaccaagcttaaagaaaacactgaatataacttccgtatttgtgccatcaattctgaaggtgtaggtgaacctgcaactctacctggctcagtggttgctcaggagaggatagagccaccagaaatagaactcgatgctgatctcagaaaggtggtcgttctgcgtgcaagtgctactttacgcttatttgtcactatcaaaggtcgaccagaacccgaagttaaatgggaaaaggcagaaggcattctcactgacagggctcagatagaggtgaccagctcatttacaatgttggtgattgataatgttaccagatttgacagtggtcggtataatctgacattagaaaataatagtggctccaaaacagcttttgttaacgtcagagttcttgactcaccaagtgcccctgtgaatttgaccataagagaagtgaagaaagactcagtgacgttgtcctgggaaccaccacttattgatggtggagctaagattacaaactacattgtcgaaaaacgagaaactacaagaaaagcctatgctaccattacaaataattgcactaaaactactttcagaattgaaaatctacaagaaggatgttcttactacttccgagtcttggcttccaatgaatatgggattggtttgccagctgaaacaacagaacccgttaaagtgtctgaaccacccctcccacctggaagagtaactcttgttgatgtgacccgtaatacagctacaattaagtgggagaaaccagaaagtgatggtggcagcaaaattactggttatgtggttgaaatgcagactaaagggagtgaaaagtggagcacctgcacacaagttaagactctagaagcaactatatctggcttaactgcaggagaagagtatgtcttcagggtagctgcagttaacgaaaagggaagaagtgatccaagacaacttggagtgccagtaattgcaagggatattgaaataaagccttcagttgagcttcctttccatactttcaatgtaaaggctagagaacaacttaagattgatgtgccattcaaaggaagacctcaagctactgtgaactggagaaaagatggtcagactcttaaagagacaactagagtcaatgtttcttcttcaaagactgtaacatcactatctattaaggaagcttcaaaggaagatgttggaacttatgaattatgtgtttcaaacagtgctggatccataacagttcctattactataattgtccttgacagaccaggacctccaggtcctatacgtattgatgaggttagttgtgacagcataaccatttcttggaatcctccagaatatgatggtggctgccaaattagcaattacattgttgaaaagaaagaaaccacctctacaacatggcacatagtttcacaagcagttgcaagaacatccattaaaatagttcgcctgacaacaggaagtgagtatcagttccgtgtttgtgcagaaaaccgctatggaaagagctcctacagtgaatcttcagctgttgttgcagagtatccattcagtcccccaggtcctcctggtactcctaaagttgtgcatgccacaaaatctaccatgcttgtaacctggcaagtgccagttaatgatggaggaagtcgagtaattggctatcatcttgagtataaagaaagaagcagcattctttggtcaaaagcaaataaaatcctcattgctgatactcaaatgaaagtctccggccttgatgaaggactgatgtatgagtatcgtgtatatgctgaaaatattgctggaattggtaaatgcagtaaatcttgtgaaccagtccctgcaagagatccttgtgaccctcctggacaacctgaagtcacaaatatcacaagaaaatcagtgtcacttaaatggtctaaaccacattatgatggtggagctaagatcacaggatacattgttgaacgcagagaactaccagatggccggtggctgaagtgcaattatactaatatacaagaaacatactttgaagtaactgaacttactgaagatcagcgttatgaattccgggtttttgcaaggaatgctgctgactcagttagtgagccatctgaatccactgggcctattatagttaaagatgatgttgagcctccaagagttatgatggatgtcaagttccgagacgttattgttgtcaaagctggagaggtccttaagataaatgcagacattgcagggcgacctctgccagtaatttcctgggccaaggatggtatagaaattgaagaaagagcaagaacagaaatcatctcaacagacaatcatactttgttaacagttaaagactgtataagacgagacactgggcaatatgtactaacactgaagaatgttgccggcactcggtctgtggccgttaattgcaaagtacttgataagcctggtccaccagcaggaccacttgaaataaatggcctcactgctgagaaatgctctctttcctggggacgtccccaagaagatggtggtgcagatatcgactattacatcgtagaaaaacgtgaaacaagccaccttgcatggacaatatgtgaaggagagttacagatgacatcctgtaaagtaaccaagttactcaaaggcaatgaatatatatttagagtaactggtgttaataaatatggtgttggtgagcccctagagagtgtagctataaaggcactagatccatttacagttccaagtccacccacgtctttggaaattacttctgtgaccaaagaatctatgacactttgctggtcaagacccgagagtgatggaggtagtgaaatatctggatatataattgaaaggcgagagaaaaatagcctaagatgggtgcgtgtaaacaaaaaaccagtttatgatctaagagtgaaatcaacaggacttcgggaaggatgtgaatatgaatatcgtgtttatgcagaaaatgctgctggcctaagtcttccaagtgaaacctctcccttaattagggcagaagatccagtgttcctaccatctcctccatccaaacccaaaattgtggactcaggcaagacaactataactattgcctgggttaagccgctgtttgatggtggggccccgataactggatatactgtagaatacaaaaaatctgatgacactgactggaaaacttccattcagagcttacgagggacagaatatacaataagcggactaacaacaggagctgaatatgttttcagagtaaaatctgtcaataaggttggtgctagtgaccccagtgatagctctgaccctcagatagcaaaggaaagagaagaagaacctttatttgatattgacagtgaaatgaggaagaccttgattgtcaaggctggtgcctcatttaccatgactgtgcctttccgaggaagaccagtacccaatgtcttgtggagtaagccagacactgacctccgtactagagcttatgttgataccacagactcccgtacatcactgaccattgaaaatgccaacagaaatgactctggaaagtacacattaacaattcagaatgttttgagtgctgcttcactgaccttagttgtcaaagttttagataccccaggtcctccaaccaacattactgtgcaagatgtaaccaaagagtctgcagtgttatcctgggatgttcctgaaaacgatggtggagcaccagtgaagaattaccacatagaaaaacgtgaggccagcaagaaagcatgggtctctgtgaccaacaactgtaaccgcctctcctacaaagttaccaatttacaagaaggagctatctattacttcagagtctctggagaaaatgagtttggtgttggtataccagctgaaacaaaggaaggagtaaaaataacagaaaaaccaagcccacctgaaaaacttggagtaacaagtatatccaaagacagtgtttccctgacctggctgaagcctgaacatgatggcggaagcagaattgtacactatgtcgttgaagcactagaaaaaggacagaaaaactgggttaaatgtgcagtggcaaagtcaacccatcacgttgtttccggtctgagagagaattctgaatactttttccgagtgtttgctgaaaatcaagctggcctgagtgacccgagagagcttctgcttcctgttcttattaaggagcaactagaaccacctgaaattgatatgaagaatttcccaagtcacactgtatatgttagagctggttcaaaccttaaagttgacattccaatctctggaaaaccacttcccaaagtgaccttatcaagagatggtgtcccccttaaggcaaccatgagatttaataccgaaattactgctgagaacctgaccatcaatctcaaagaaagtgttacagctgacgctgggagatatgaaatcactgctgccaactccagtggtacaaccaaagctttcattaacattgttgtgctagacaggcctggtcctccaactggccctgttgttattagtgatataactgaagaaagtgtgactctcaaatgggagccacctaagtatgacggtggaagtcaagttaccaactacattctactcaaaagagaaacaagtactgcagtgtggactgaagtgtctgcaacagttgcaagaaccatgatgaaagtcatgaaactgaccacaggagaagaataccaattccgcatcaaggcagaaaaccgctttggcatcagtgatcatatagattcagcttgtgtgactgtcaaactaccatacacaacacctggaccaccatctacaccatgggtcactaatgttactcgagaaagcatcactgtgggctggcatgaaccagtgtcaaatggaggcagtgcagtcgtaggctatcacctggaaatgaaagacagaaacagtattttatggcaaaaagccaacaaactggtcatccgcacaactcacttcaaagtcacaacaatcagtgctggacttatttatgaattcagggtgtatgcagaaaatgctgctggagttggaaaacctagccatccttctgaaccagtcttggcaattgatgcttgtgaacccccaagaaatgttcgtatcactgatatttcaaagaactctgtcagcctttcatggcaacaaccagctttcgatggaggtagcaagattacaggctacattgttgagagacgtgaccttccagatggcagatggaccaaggccagcttcaccaatgttactgaaactcaattcatcatctctggcttgactcagaattcccagtatgaattccgtgtctttgctaggaatgctgttggttccattagcaatccatctgaggttgtagggcccattacttgcatcgattcttatggtggtcctgtaattgatttgcctctagaatatacagaagttgtcaaatacagagcaggtacatctgtgaagctcagagctggcatttctggcaaacctgcgcctactattgagtggtataaagatgataaagaattacaaaccaatgcactggtgtgtgttgaaaataccacggacctcgcatctatactcatcaaagatgccgatcgccttaatagtggatgctatgaattaaaactaaggaatgccatgggctcagcctcagccaccatcagagtacagatccttgacaaaccaggcccacctggtggaccaattgaatttaagactgtaactgctgagaagatcacccttctctggcggcctccagctgatgatggtggtgcaaaaatcactcactacattgtggaaaagcgtgagacaagccgcgttgtgtggtctatggtgtctgaacatttggaagagtgcatcattacaaccaccaaaattatcaaaggaaatgaatacatcttccgggtccgagccgtgaacaaatatggaattggcgagccactggaatctgattccgttgtagccaagaacgcatttgttacacctgggccaccaggcataccagaagtgacaaagattaccaagaattcgatgactgttgtatggagcaggccaattgcagatggcggtagtgatataagtggctatttccttgaaaaacgagacaagaagagcctaggatggtttaaagtactaaaagagactatccgtgacaccagacaaaaagtaacaggactcacagaaaacagtgactatcaatacagagtttgtgctgtaaacgctgctggacagggtccattttctgaaccatctgaattctacaaagctgctgatcctattgatcctccaggtccacctgctaagataagaatcgcagattcaaccaagtcatccatcacccttggctggagtaagcctgtctatgatgggggcagtgctgttactgggtatgttgtcgagataagacaaggagaggaagaggaatggactactgtctctaccaaaggagaggtcagaactacagaatatgtggtatccaacctgaaacctggagtcaattactacttccgggtatctgctgtaaactgtgctggacaaggagaacctatagaaatgaatgaacctgtacaagctaaagatatacttgaggcaccagagattgacctggatgtggctctcagaacttctgttattgccaaagctggtgaagatgtacaagtgttgattccctttaaaggcagacctccacctactgtcacatggagaaaagatgagaagaatcttggcagtgatgccagatacagcattgaaaacactgattcatcctcattactcaccattcctcaagttactcgcaatgatacaggaaaatatattctcacaatagaaaatggagttggtgaacctaagtcttcaactgtgagtgttaaagtgcttgacacaccagctgcctgccagaaactacaggttaaacatgtttctcgaggcacagtcactttgctctgggatcctcctctcattgatggaggatctccaataattaattatgtcattgaaaagagagatgccaccaagagaacatggtctgtcgtgtcacacaaatgttctagcacatccttcaagctaatagatttgtcggagaagactccattcttcttcagagttcttgcagaaaatgaaattggaattggggaaccctgtgaaactacagagccagtgaaggctgctgaagtaccagctcctatacgtgatctctcaatgaaagactcaacaaagacatctgtcatcctcagctggaccaaacctgactttgatggtggtagcgtcatcacagaatatgttgtagaaaggaaaggtaaaggtgaacagacgtggtcccacgctggcataagtaagacatgtgaaattgaggttagccaacttaaggagcagtcagtcctggagttcagagtgtttgccaaaaatgagaaaggactgagtgatcctgtcactattgggccaattacagtgaaagaacttattattacacctgaagttgacctgtcagatatccctggggcacaagtcactgtgagaattgggcacaatgtgcaccttgaattaccttataagggaaaacccaaaccatccatcagttggctgaaagatggcttgccactgaaagaaagtgaatttgttcgcttcagtaaaactgaaaacaaaattactttgagtattaagaatgccaagaaggagcatggaggaaaatacactgttattcttgataatgcagtgtgtagaattgcagtccccattacagtcatcacccttggcccaccatcaaagcccaaaggacccattcgatttgatgaaatcaaggctgatagtgtcatcctgtcatgggatgtacctgaagataatggaggaggagaaattacttgttacagcatcgagaagcgggaaacttcacaaactaactggaagatggtgtgttcaagtgttgccagaacgactttcaaagttcctaatctagtcaaagatgctgagtaccagtttagagtgagagcagaaaacagatacggagtcagccaaccacttgtctcaagcattattgtggcaaaacaccagttcaggattcctggtcccccaggaaagccagttatatacaatgtgacttctgatggcatgtcactaacttgggatgctccagtttatgatggtggttcagaagttactggattccatgttgaaaagaaagaaagaaatagcatcctctggcaaaaagttaatacatcaccaatctctggaagagaatatagagccactggactggtagaaggtctggattaccaattccgtgtatatgctgaaaattctgctggcctaagctcacctagtgacccaagcaaatttaccttagctgtttctccagtagacccacctggcactcctgactacattgatgtcacccgggaaaccatcacacttaaatggaacccaccattgcgtgatggaggcagtaagattgtgggctatagcattgagaaacggcaaggaaatgaacgctgggtgagatgcaactttactgacgtcagtgaatgtcagtacacagttacaggactcagtcctggggatcgctatgagttcagaataattgcaagaaatgctgttggaactataagcccgccctcacagtcttctggcattattatgacaagagatgaaaatgttccaccaatagtagagtttggccctgaatactttgatggtctcattattaagtccggagagagccttagaattaaagctttggtacaaggaagaccagtgcctcgagtaacttggttcaaagatggagtggaaatcgaaaagaggatgaatatggaaataaccgacgtacttggatccaccagcctatttgttagagatgctactcgggaccatcgtggtgtatacacagtggaagccaaaaatgcatctggttctgcaaaagcagaaattaaagtgaaagtacaagatacaccaggaaaagtagttgggccaataagattcaccaatattactggggagaagatgactctgtggtgggatgccccactcaatgacggttgtgctcccataacccactacatcattgaaaaacgggaaaccagcagacttgcctgggcactaattgaggataaatgtgaagcccaaagttacactgccattaaactaataaacggcaatgaataccaattccgtgtttctgcagttaacaagtttggtgttggcaggccacttgattctgatccagtggttgctcaaatacaatatactgttcctgatgcccctggcattccagaacctagcaacataacaggcaacagcattaccctgacatgggcaaggccagaatcagatggtggcagtgaaattcaacagtatatccttgaaagaagagaaaagaaaagcacaagatgggtaaaagtgatcagcaaacgaccaatctctgaaacaagattcaaagtcactggtctgacagaaggcaatgagtatgaattccatgtcatggctgaaaatgctgcaggagttggacctgcaagtggcatctcaagactcattaaatgtagagagcccgtcaacccaccaggtcctcccacagtggtcaaagtaacagacacatcaaagacaactgtgagcttagaatggtccaaaccagtgtttgatggtggcatggaaataattgggtatattattgaaatgtgtaaggccgacttaggagactggcacaaggtgaatgcagaggcatgtgtgaaaacaagatatacagtcactgatctacaagcaggtgaagaatacaaattccgagttagtgctatcaatggtgctggaaaaggcgacagctgtgaagtgactggcacaattaaagcagttgaccggttaacagctcctgagttagacatagatgcaaacttcaaacagactcatgttgttagagctggggccagtattcgcctcttcattgcctaccaaggtagacctactcctacagctgtgtggagcaaaccagactctaaccttagccttcgggctgatatccatacaacagattccttcagcaccctcactgtggaaaactgcaacagaaatgatgcagggaaatatacccttactgtggaaaacaacagtggtagtaagtcaatcacattcaccgtgaaagtgctagacactccaggcccacctggcccaattaccttcaaagatgtgacccggggatctgctacattgatgtgggatgcccctcttcttgacggtggtgcccgaatccatcattatgtggtagagaaacgagaggcaagtcgccgtagttggcaggttatcagtgaaaaatgcactcgtcagatcttcaaggtcaatgacctggccgaaggtgttccgtactatttccgtgtttctgcagtaaatgagtatggtgttggtgagccctatgaaatgccagaaccaattgtagccacagaacagcctgctccacctaggagacttgatgttgttgatactagcaaatcctccgcagtcttagcttggcttaaacctgaccacgatggaggcagccggatcactggctacctgcttgaaatgagacaaaagggatctgacttctgggttgaagctggtcacaccaaacagctaactttcacagtagagcgtcttgttgagaaaactgaatatgaattccgtgtgaaggccaagaatgatgctggctatagtgaacccagagaagccttctcttctgtcatcattaaggagcctcaaatcgagcccactgctgacctcactggaattaccaatcagcttataacttgcaaagcaggaagcccatttaccattgacgtaccaatcagtggtcgtcctgcccccaaagtaacatggaaactggaagaaatgagacttaaagagacagatcgagtgagcattacaacaacaaaagacagaaccacactgactgtaaaggacagcatgagaggtgactctggaagatacttcttgaccctggaaaatacagctggtgttaaaacatttagcgtcacagttgtggtcattggaaggccaggtccagtaaccggccccattgaggtctcatctgtctcagctgaatcgtgtgtcctgtcatggggagaacctaaagatggaggaggcactgaaattactaattacatagttgaaaagcgtgaatcgggtacaacagcttggcagcttgtcaattccagtgtcaagcgcactcaaattaaagtcactcatctcacaaaatacatggaatattctttccgtgtcagttcagagaacagatttggtgtcagcaaacctctagaatcagcaccaataattgctgaacatccatttgtcccaccaagcgctcctaccagacctgaggtctaccatgtgtctgccaatgccatgtctattcgttgggaagaaccctaccacgatggtggcagtaaaatcattggctactgggttgagaagaaagaacgtaatacaattctttgggtgaaagaaaacaaagtgccatgcttagagtgcaactacaaagtaactggtttagtagaaggactggaatatcagttcagaacttatgcactcaatgctgcaggtgttagcaaggccagcgaagcttcaagacctataatggctcaaaatccagttgatgcaccaggcagaccagaggtgacagatgtcacaagatcaacagtatcactgatttggtctgccccagcgtatgatggaggcagcaaggttgtgggctacatcatagagcgtaagccagtcagtgaggtaggagatggtcgctggctgaagtgcaactacaccattgtatctgacaatttcttcaccgtgactgctctcagtgaaggagacacttatgagttccgtgtgttagccaagaatgcagcaggcgtaattagcaaagggtctgaatctacaggccctgtcacttgccgagatgaatacgctccacccaaagccgaactggatgcccgattacacggtgatctggttaccatcagagcaggttctgatcttgttctggatgctgcagttggtggcaaacctgaacccaaaattatctggaccaaaggagacaaggagctagatctctgtgaaaaagtctctttgcagtatactggcaaacgagcaactgctgtgatcaagttctgtgacagaagtgacagtggaaaatacactttaacagtgaaaaatgccagcgggaccaaggccgtgtctgtcatggtcaaagtgcttgattcccctggcccatgtggaaagctcaccgtcagcagagtaacacaggagaagtgcactttagcctggagccttccgcaggaagacggaggagcagaaatcactcactacatcgtggaaagacgcgagactagcaggctcaactgggtgattgttgaaggcgaatgcccaaccctatcctatgtcgttaccaggctcatcaagaacaatgagtacatattccgagtgagggcagtaaacaaatatggccctggtgtgcctgttgaatcagagccaattgtagccagaaactcattcactattccatcaccacccggcatacctgaagaagttgggactggcaaagagcatatcatcattcagtggacaaaacctgaatctgatggtggcaatgaaatcagcaactacctagtagacaaacgtgagaagaagagcctgcgctggacacgtgtcaacaaagactatgtggtgtatgataccaggctgaaggtgaccagcctgatggagggttgtgattaccagttccgggtgaccgcagtgaatgcagctggtaacagtgagcccagcgaagcttccaacttcatctcatgcagagaaccatcatatacccctggaccaccttctgctccaagagttgtggataccaccaaacacagcattagtttggcatggaccaaacccatgtacgatggtggtactgacattgtaggatatgttctggaaatgcaagagaaggacactgatcagtggtaccgagtgcataccaatgccacaataagaaatactgaattcactgtgccagaccttaaaatgggccagaaatattccttcagagttgctgccgtgaacgtgaagggtatgagcgaatacagcgaatcaattgctgaaattgagcccgtggaaagaatagaaataccagatcttgagcttgcagatgatctaaagaagactgtgaccatcagggctggggcctccttgcgcttgatggtgtctgtatctggaagaccacctcctgtcataacgtggagcaagcagggcattgaccttgcaagccgggcaattattgacaccactgagagctactcattgctaatagtggacaaagttaatcggtacgatgctggaaaatacacaattgaagctgaaaaccaatctggcaagaaatcagcaacagtccttgttaaagtctatgatactcctggtccctgtccttcagtgaaagttaaggaagtatcaagagattctgtgactataacttgggaaattcccacgattgatggtggagctccagtcaacaattacatcgttgagaagcgtgaagctgctatgagagcattcaaaacagtaactaccaaatgcagcaagacactttacagaatttctggacttgtagaaggaaccatgtactatttcagagtgctgccagaaaatatttatggcattggagaaccttgtgaaacatctgatgcagtactggtctcagaagtgcctttggtgcctgcaaagctagaagtggtcgatgtcaccaaatccactgttacccttgcctgggaaaaaccactctacgatggtggtagccgactcactggatatgttctcgaggcctgcaaagctggcacagagagatggatgaaggttgtcaccttaaaacccacagtcctagagcacactgttacttccttaaatgaaggtgaacaatacttatttagaataagggcacaaaatgagaaaggtgtgtcagaaccaagagagactgtcacagccgtgactgtacaagacctcagagtgttgccaacaatcgatctttctacaatgcctcagaagaccatccatgtcccagctggcagaccagtagagctggtgatacctattgctggccgtccacctcctgctgcttcctggttctttgctggttctaaactgagagaatcagagcgtgtcacagttgaaactcacactaaagtagctaaattaaccatccgtgaaaccactatcagagatactggagaatacacacttgaattgaagaatgttaccggaactacttcagaaaccattaaagttatcattcttgacaagcctggtccaccaacaggacctattaagattgatgaaattgatgctacatcaattaccatttcctgggaaccacctgaattggacggtggtgctccactgagtggttatgtggtagaacaacgtgacgctcatcgtccaggatggctgcccgtttctgaatcagtgactaggtccacgtttaagtttaccagactcaccgaaggaaatgagtatgtgttccgtgtggctgcaacaaaccgcttcgggattggctcttacttgcagtctgaggtcatagagtgtcgcagcagcatccgtattcctggacccccagaaacattacagatatttgatgtttcccgtgatggcatgacacttacttggtacccaccagaggatgacggtggctcccaagtgactggatatattgtggagcgcaaagaagtgagagcagatcgatgggtccgtgtaaataaagtacctgtgacaatgacacggtaccgctccactggccttactgaaggcttagaatatgaacaccgtgtcacagccattaatgcaagagggtctgggaaaccaagtcgtccttccaaacccatcgttgccatggatccaattgctcctccaggaaagccacaaaacccaagagttactgatacaacaaggacatcagtctccctggcctggagtgttccagaagatgaaggaggatctaaagtcacaggctacttgattgaaatgcaaaaagtagatcaacatgaatggaccaagtgtaacaccactccaaccaagattcgagagtatactctaacacacctacctcagggtgcagaatacaggttccgcgtcctagcttgtaatgctggtggacctggtgagcctgctgaggtaccaggaacagtcaaagtcactgaaatgcttgaatatcctgattatgaacttgatgaaagataccaagaaggtatctttgtaaggcaaggtggcgtcatcagacttaccataccaatcaaaggaaaaccattcccaatatgtaaatggaccaaggaaggccaggatattagtaagcgtgccatgattgcaacatctgaaacacacactgagcttgtgatcaaagaagcagacaggggtgattctggcacttatgacctggttctggaaaataaatgtggcaagaaggctgtctacatcaaggtcagggtgataggaagtcccaacagtccagaagggccactggaatatgatgacatccaagtccgctctgtgagggtcagctggagacctcctgctgatgatggtggtgctgacatcttaggctacatcctcgagagacgagaagtgcctaaagccgcctggtataccattgattccagagtccgaggtacatctctggtggtaaaaggcctcaaagagaatgtagaataccatttccgtgtttcagcagaaaaccagtttggcataagcaaacccttgaaatctgaggaaccagtcacaccaaaaacaccattgaatcctccagaacctccaagcaatcctccagaagtactcgatgtaaccaagagttctgttagcttgtcctggtcccggcccaaagatgatggtggttctagagtcacaggctactacatcgaacgcaaagagacatccactgacaagtgggtcagacacaacaagactcagatcaccaccacaatgtacactgtcacagggcttgttcccgatgctgagtatcagttccgcatcatcgcacagaatgatgttggcctgagtgagaccagccctgcttctgaaccagttgtttgcaaagatccatttgataaaccaagccaaccaggagaacttgagattctttcaatatccaaagatagtgtcactctacagtgggagaaacctgaatgtgatggtggtaaagaaattcttggatactgggttgaatatagacagtctggagacagtgcctggaagaagagcaataaggaacgtattaaggacaagcaattcacaataggaggtttgctggaagctactgagtatgaattcagggtttttgctgagaatgagactgggctgagcagacctcgcagaactgctatgtctataaagactaaactcacatctggagaggccccaggaatacgcaaagaaatgaaggatgttaccacaaaattgggtgaagctgctcaactctcatgccagattgttggaaggcctcttcctgacattaaatggtacagatttggtaaagagctcatacaaagccggaaatacaaaatgtcttcagatggacgcacacacactcttacagtaatgacagaggaacaggaagatgaaggtgtttatacctgcatagccaccaatgaggttggagaagtagaaaccagtagtaagcttctcctgcaagcaacaccgcagttccatcctggttacccactgaaagagaaatattatggagctgtgggttccacacttcggcttcatgttatgtacattggtcgtccagtacctgccatgacttggttccatggtcagaaacttttgcaaaactcagaaaacattactattgaaaacactgagcactatactcatcttgtcatgaagaatgtccaacgtaagactcatgctgggaaatacaaagtccagctcagcaatgtttttggaacagttgatgccatccttgatgtggaaatacaagataaaccagacaaacctacaggaccaattgtgatcgaagctctattgaagaactccgcagtgatcagctggaaaccacccgcagatgacggaggctcctggatcaccaactatgtggtggaaaaatgtgaggccaaggagggggctgaatggcaattggtgtcttcagccatctcagtgacaacctgtagaattgtgaacctcacagaaaatgctggctattacttccgggtttcagctcagaacactttcggcatcagtgaccctctagaagtgtcctcagttgtgatcattaagagtccatttgaaaagccaggtgctcctggcaaaccaactattactgctgtcacaaaagattcttgtgttgtggcctggaagccacctgccagtgatggaggtgcaaagattagaaattactaccttgagaagcgtgagaagaagcagaataaatggatttctgtgacaacagaagaaattcgagaaactgtcttttcagtgaaaaaccttattgaaggtcttgaatacgagtttcgtgtgaaatgtgaaaatctaggtggggaaagtgaatggagtgaaatatcagaacccatcactcccaaatctgatgtcccaattcaggcaccacactttaaagaggaactgagaaatctaaatgtcagatatcagagcaatgctaccttggtctgcaaagtgactggtcatccaaaacctatcgtcaaatggtacagacaaggcaaagaaatcattgcagatggattaaaatataggattcaagaatttaagggtggctaccaccagctcatcattgcaagtgtcacagatgatgatgccacagtttaccaagtcagagctaccaaccaagggggatctgtgtctggcactgcctccttggaagtggaagttccagctaagatacacttacctaaaactcttgaaggcatgggagcagttcatgctctccgaggtgaagtggtcagcatcaagattcctttcagtggcaaaccagatcctgtgatcacctggcagaaaggacaagatctcattgacaataatggccactaccaagttattgtcacaagatccttcacatcacttgttttccccaatggggtagagagaaaagatgctggtttctatgtggtctgtgctaaaaacagatttggaattgatcagaagacagttgaactggatgtggctgatgttcctgacccacccagaggagtcaaagttagtgatgtctcacgagattctgtcaacttaacatggactgagccagcctctgatggtggcagcaaaatcaccaactacattgttgaaaaatgtgcaactactgcagaaagatggctccgtgtaggacaggcccgagaaacacgttataccgtgatcaacttatttggaaaaacaagttaccagttccgggtaatagctgaaaataaatttggtctgagcaagccttcagagccttcagaaccaaccataaccaaagaagataagaccagagctatgaactatgatgaagaggtagatgaaaccagggaagtctccatgactaaagcatctcactcttcaaccaaggaactctatgagaaatatatgattgctgaagatcttgggcgtggtgagtttggaattgtccatcgttgtgttgaaacatcctcaaagaagacatacatggccaaatttgttaaagtcaaagggactgatcaggttttggtaaagaaggaaatttccattctgaatattgctaggcatagaaacatcttacacctccatgaatcatttgaaagcatggaagaattagttatgatctttgagtttatatcaggacttgacatatttgagcgcattaacacaagtgcttttgaacttaatgaaagagaaattgtaagttatgttcaccaggtctgtgaagcacttcagtttttacacagtcataatattggacactttgacattagaccagaaaatatcatttaccaaaccagaagaagctctaccattaaaatcatagaatttggtcaagcccgtcagctgaaaccaggggacaacttcaggcttctattcactgccccagaatactatgcacctgaagtccaccagcatgatgttgtcagcacagccacagacatgtggtcacttggaacactggtatatgtgctattgagtggtatcaacccattcctggctgaaactaaccaacagatcattgagaatatcatgaatgctgaatatactttcgatgaggaagcattcaaagagattagcattgaagccatggattttgttgaccggttgttagtgaaagagaggaaatctcgcatgacagcatcggaggctctccagcacccatggttgaagcagaagatagaaagagtcagtactaaagttatcagaacattaaaacaccggcgttattaccacaccctgatcaagaaagacctcaacatggttgtgtcagcagcccggatctcctgtggtggtgcaattcgatctcagaagggagtgagtgttgctaaagttaaagtggcatccattgaaattggcccagtttctgggcagataatgcatgcagttggtgaagaaggaggacatgtcaaatatgtatgcaaaattgaaaattatgatcagtctacccaagtgacttggtactttggcgtccgacagctggagaacagtgagaaatacgaaatcacctacgaagatggagtggccatcctctatgtcaaagacattaccaaattagatgatggtacctacagatgcaaagtagtcaatgactatggtgaagacagttcttatgcagagctatttgttaaaggtgtgagagaagtctatgactattactgccgtagaaccatgaagaaaattaagcgcagaacagacacaatgagactcctggaaaggccaccagaatttaccctgcctctctataataagacagcttatgtaggtgaaaatgtccggtttggagtaactataactgtccacccagagcctcatgtaacatggtataaatcaggtcagaaaatcaaaccaggtgacaatgacaagaagtacacatttgagtcagacaagggtctttaccaattaacaatcaacagtgtcactacagatgatgacgctgaatatactgttgtggcaaggaacaaatatggtgaagacagctgtaaagcaaagctgacagtaaccctacacccacctccaacagatagtaccttaagacccatgttcaaaaggttactggcaaatgcagaatgccaagaaggccaaagtgtctgctttgagatcagagtgtctggcatccccccaccaacattaaaatgggagaaagatggtcagccactgtccctcgggcctaacattgaaattatccatgaaggcttggattattatgctctgcacatcagggacactttgcctgaagacacgggttattatagagtcacagccactaacacagctgggtccaccagctgccaggctcacctacaagtggaacgcctgaggtacaagaaacaggaattcaagagtaaggaggagcatgagcgacacgtacaaaaacaaattgacaaaaccctcagaatggctgaaattctttctggaactgaaagtgtaccactgacacaggtagctaaagaggctctgagagaagctgctgtcctttataaaccggctgtaagcaccaagactgtaaaaggggaattcagacttgagatagaagaaaagaaggaggagagaaaactccggatgccttatgatgtaccagagccacgcaagtataagcagactaccatagaagaagaccaacgcatcaagcagttcgtgcccatgtctgacatgaagtggtataaaaagatacgtgatcagtatgaaatgcctgggaaacttgacagagttgtacagaaacgacccaagcgcatccgcctttcaagatgggaacagttctatgtgatgcctcttccacgcattacagatcaatacagacctaaatggcgtattcctaaactgtcccaagatgatcttgagatagtgagaccagcccgccggcgtacaccttctcctgattatgacttttactaccgacctagaagacgttctcttggggacatctctgatgaagaattactcctccccattgatgactacttagcaatgaaaagaacagaggaagagaggctgcgtcttgaagaagagcttgagttaggtttttcagcttcacccccaagtcgaagccctccacactttgagctttctagcctacgttactcttcaccacaagctcatgtcaaggtggaggaaacaagaaaagacttcaggtattcaacctatcacatcccaacgaaggctgaagctagtacaagttatgcagaactgagggaacggcatgcccaggctgcgtacagacagccaaagcaacggcaaagaatcatggctgagagggaggatgaagagttgcttcgcccagttacgaccacccagcatctctcagaatacaaaagcgaacttgacttcatgtcaaaggaggaaaagtctagaaagaaatcaaggcgacaaagagaagtgacagaaataacagaaattgaggaagaatacgaaatctcaaaacatgctcaaagagaatcatcctcatctgcgtctagactactgagacgacggcgctccctgtctccaacttatattgagttaatgaggccagtgtctgagctgatccggtcacgtccacaaccggctgaggaatacgaagatgacacagaaagaaggtcacctactccagagagaactcgcccacgatcccccagccctgtgtctagtgagagatcactctcgagatttgagaggtctgcaagatttgatatcttttccaggtatgagtccatgaaagctgctttaaaaactcagaagacatcagaaaggaagtatgaagttttgagtcagcagcctttcacactggaccatgcccctcgaatcacactgagaatgcgctcgcacagggtaccatgtggccaaaatacacgttttattttaaatgttcagtctaagccaactgccgaggttaaatggtaccacaatggtgtggaactccaagaaagcagtaagattcattacaccaacacgagtggagtcctcaccctggaaattctggactgtcatactgatgacagtggaacctaccgtgctgtgtgcaccaactacaagggcgaagcttctgactatgcaacgttggacgtgacaggaggggattataccacctatgcttcccaacgcagagatgaagaggtccccagatctgttttccctgagctgacaagaacagaggcgtatgctgtttcatcatttaagaaaacatctgagatggaagcttcgtcttctgtcagggaagtgaaatcacagatgacggagacaagggaaagtctctcctcatatgaacactctgcatctgcagaaatgaaaagtgctgcattagaagaaaagtcactggaagaaaaatccacaaccagaaagatcaagacgactttggcagcaagaattctaacaaagccacggtccatgaccgtctacgagggcgagtctgcaaggttttcttgtgacaccgatggtgagccggtaccaactgtgacctggctgcgtaaaggacaagtgctaagtacttctgcccgccaccaagtgaccaccacaaagtacaaatcaacctttgagatctcttcagtccaggcttccgatgagggcaattacagcgtggtggtagaaaacagtgaagggaaacaagaagcagagttcactctgactattcaaaaggccagggtaactgaaaaggctgtgacatcaccaccaagagtcaaatccccagagcctcgggtgaaatccccagaagcagttaagtctccaaaacgagtgaaatctccagaaccttctcacccgaaagccgtatcacccacagagacaaaaccaacaccaacagagaaagttcagcacctcccagtctctgccccaccaaagattactcagttcctgaaagcagaagcttctaaagagattgcaaaactgacctgtgtggttgaaagcagtgtattaagggcaaaagaggtcacctggtataaagatggcaagaaactgaaggaaaatgggcatttccagtttcattattcagcagatggtacctatgagctcaaaatcaataacctcactgaatctgatcaaggagaatatgtttgtgagatttctggtgaaggtggaacgtctaaaaccaacttacaatttatggggcaagcctttaagagtatccatgagaaggtatcaaaaatatcagaaactaagaaatcagatcagaaaaccactgagtcaacagtaaccagaaaaactgaaccaaaagctcctgaaccaatttcctcaaaaccagtaattgttactgggttgcaggatacaactgtttcttcagacagtgttgctaaatttgcagttaaggctactggagaaccccggccaactgccatctggacaaaagatggaaaggccattacacaaggaggtaaatataaactctctgaagacaagggagggttcttcttagaaattcataagactgatacttctgacagtggactttatacttgtacagtaaaaaattcagctggatctgtgtcctctagctgcaaattaacaataaaagctataaaagatactgaggcacagaaagtctctacacaaaagacttctgaaattacacctcagaagaaagctgttgtccaagaggaaatttcccaaaaagccctaaggtctgaagaaattaagatgtcagaggcaaaatctcaagaaaagttagccctcaaagaggaagcttcaaaggttctgatttctgaagaagtcaagaaatcagcagcaacctccctggaaaaatccattgtccatgaggaaatcactaaaacatcacaggcatcagaagaagtcagaactcatgctgagattaaagcattttctactcagatgagcataaacgaaggtcaaagactggttttaaaagccaacattgctggtgccactgatgtgaaatgggtactgaatggcgtagagcttaccaactctgaggagtaccgatatggtgtctcaggcagcgatcagaccctaaccatcaagcaagccagtcacagagatgaaggaatcctcacctgcataagcaaaaccaaggaaggaatcgtcaagtgtcagtatgatttgacactgagcaaagaactctcagatgctccagccttcatctcacagcctagatctcaaaatattaatgaaggacaaaatgttctctttacttgtgaaatcagtggcgagccatcccctgaaatcgaatggtttaaaaacaacctgccaatttctatttcttcaaatgtcagcataagccgctccagaaatgtatactcccttgaaatccgaaatgcatcagtcagcgacagtggaaagtacacaattaaggccaaaaatttccgtggccagtgttcagctacagcttccttaatggtccttcctctagttgaagaaccttccagagaggtagtattgagaacaagtggtgacacaagcttgcaaggaagcttctcgtctcagtcagtccaaatgtctgcctccaagcaggaggcctccttcagcagtttcagcagcagcagtgctagcagcatgactgagatgaaatttgcaagcatgtctgcccaaagcatgtcctccatgcaagagtcctttgtagaaatgagttccagcagctttatgggaatatctaatatgacacaactggaaagctcaactagtaaaatgcttaaagcaggcataagaggaattccgcctaaaattgaagctcttccatctgatatcagcattgatgaaggcaaagttctaacagtagcctgtgctttcacgggtgagcctaccccagaagtaacatggtcctgtggtggaagaaaaatccacagtcaagaacaggggaggttccacattgaaaacacagatgacctgacaaccctgatcatcatggacgtacagaaacaagatggtggactttataccctgagtttagggaatgaatttggatctgactctgccactgtgaatatacatattcgatccatttaagagggcctgtgcccttatactctacactcattcttaacttttcgcaaacgtttcacacggactaatctttctgaactgtaaatatttaaagaaaaaaaagtagttttgtatcaacctaaatgagtcaaagttcaaaaatattcatttcaatcttttcataattgttgacctaagaatataatacatttgctagtgacatgtacatactgtatatagccggattaacggttataaagttttgtaccatttattttatgacattttacaatgtaagttttgaaactaactgttggtaggagaaagtttcttatggaacgaataccctgctcaacatttaatcaatctttgtgcctcaacatactgttgatgtctaagtatgcctcagtgggttgagaaaatccccattgaagatgtcctgtccacctaaaagagaatgatgctgtgcatatcacttgatatgtgcaccaatacctactgaatcagaaatgtaaggcattggtgatgtttgcatttaccctcctgtaagcaacactttaacgtcttacattttctctgatgatgtcacacaaaattatcatgacaaatattaccagagcaaagtgtaacggccaacactttgttcgctcattttacgctgtctctgacataaggagtgcctgaatagcttggaaaagtaacatctcctggccatcccttcatttaaccaagctattcaagtattcctatgccagagcagtgccaactcttggaggtcccagagtgcagccaatgcctttgtgtggtagttctaaattttaattgcacctgaaaaacctgggcacctaagcaatgagccacagcaaaaagtaaagaacaacaacaaaataaagctgttgttaaattttaaacaatattactaattgcccaaaatgtcaatttgatgtagttcttttcatgcaagtataaattcaattgttagttataattgttggacctccttgagatagtaacaacaaaataaagcaagctatctgcacctcaaaa

SEQ ID NO: 2954 - DNA, 17303 bp, Homo sapiens
agcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcaagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataagacaggaaactgagataactgctgcatccatggtggtagttgccactgcaaagtccacaaaactagaaacagtcccgggagctcaagaagaaactaccacacaacaagatcaaatgcacctaagttatgaaaagataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgatttaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatcacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagagtacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaagctcctgaatcaattttgcatgagaggattgaacaagagattgagatggaaatgaaagaattattctctgagggggaatctgaacattcagaaagggatacacgtgacgccttttcagattctgaagacatagaccacaaatccatggctgctaaaagatatgcaagtagaatatcatctacaagctcctggcctgaatattttaagccttcttttacccagaaacttacatttaaatatgttttagagggtgaaccggttgtttttacatgtagattaattgcctgtccaactccagaaatgacttggtttcataacaatcggcccatcccaacaggtcttcgtcggattataaaagctgagagtgatttacaccatcactcttccagcttagagattaaaagggtccaagacagagattctggaagttataggttactagcaattaatagtgaagggtctgcagaatcaactgcatcattgcttgttatccaaaaagggcaagatgagaaatatttagaatttctgaaaagagcagaacggacacatgaaaatgtggaggctttagttgaaaggggagaagataggataaaggttgacctgaggtttactggctctccctttaacaaaaaacaagatgtggaacaaaagggaatgatgagaactatacattttaagacaatgagttctgccaagaaaacagattacatgtatgatgaagaatatttagaaagtaaatctgacataagaggttggcttaatgtaggtgaaagtttcctggacaaggagaccaaagtgaagttgcaacgtttaagggaggctagaaaaacgttaatggagaaaaagaaattatctcttttagatacgtcttctgaaataagctcaagaactttcagaagtgaagctagtgataaagatattctgttctctagagaggacatgaaaatcagatctatgtctgatctagctgaaagttataaggtagatcattcagctgagagtattgtgcaaaatccacatgccctttctaatcaaatggatcaaaatatagaatctgaggaacttcccacaagctttcaaactattgttgatgaagaaattttccagactgaaataagaatgagccaagaagcactggtaaaggaaagtctaccaaaagaccatttatatggtgaaattctagtaaatgaaaatacccaagcaagaggacagctggaagaaattatggccaatactacaattggagagtcatccacatatatcactaatgtatgtgagaaggaggaagtatatgagactcctgaaaatgtgtctcaagctattacaccacatgccagcgaatcttttggtacacttgtaaatgttgaagaaagtgaagaaatagctagtgaaagaataaaaaaggatgatttgagagaattacaactctctgcttctacacgaattgatgaattcaaaaccgaacagaaggaagaaaacatgagattttttgaaaattcttttcgaaaacgcccacaacgttgcccaccttcatttcttcaagaaattgaatctcaagaagtttatgaaggtgacagttgtaattttgtgtgtcattttcaaggatatcctcaacctatagtgacgtggtataacaatgacatgccaatcccacgtaatcaaaactttatcattcattcgttggaaaactattcaatattaactctttcatctgttcatcatcagaatgaaggttctattacttgtgtgctatttaaccaatatggaacagtaaaaacaaccagtatgcttaaagtgaaagcaaaacaaaaacatgatgtcaaagcacataaagtcccagtgttccatgactacttggatgaggaagaagagctagcattggtgtttgaccaagcaaaaggcgcccatccatctatgagtcaagagggccaaacaaatcttcatttgttaaaaactaacccaccagttcctccctctggagacacagaattgctttcctttcctgtagaaattcaggtaacagcagctactcctatcccagaacaggataaagagtctaaagaagtgtttcaaactgaggagctggaacctaaagcaatgcctcaagatcaagttactcaatcaccaaaacacagatttgtatttttgtctgatattactaatgaaccaccaaaaatgttacaagaaatgccaaagcatgccaggtgtagagaaggggattccatcattcttgaatgtttaatatctggtgagccccagccagttgtaacatggtttcaaaatggagtccttttaaagcagaaccagaagtttcagtttgaagaagttaattgtagccaccaattatatattaaggatgttaattctcaagattctggaaaatataaatgtgttgctgaaaacaattcaggggcagttgaaagtgtttcagatctaacagtggagcctgtcacttatagagaaaatagtcaattcgaaaatattggtgaaatttatggaaaatattccagagatcagcaactgcaagaccagggagaatctgtaagggcacatttttatgattatccagctggtccctttactccctggacaaatgtaaaagaatattcagtaagggactattttcaaagccttgagactattgagcaaatagaccagaaagagcaggtgcgttgcataccttctagagaaaaaattcccagatttgtgcatggtgcttcaagaaccataaaaatcagcaagcccatcagggctgaattcatacaatgtcaggctgaagggaaagagagacatgtaagtgaaaaatcaaagctgcaccaagcagagggtactgtttatccatttgttgatgatttcagtgatgtcactattaagaaagaaataagaaataattttggaaaacttggtagatcagaaaaggaaaatgtacaagaatgtgcccaaagtgactatttaccaaatattcactctgagagaatttctgacagttacaatacaaaagattcatctgccattgtatatgaagaatcccttggtgaagagatacactacccggggaaaaaggtgaagcatagaattatcgaatttgaaaaattacatgtagaaaaaggagttctagaaaaaagacctaccagaacatcaattgttaatcctcctcaaaagaagattgatgacaaagccttttcattaaagcaaagagaatcaagatcaagcaatctaaatgcaaatatgtatcaggcagagaaaatgtctccaaatactgaatcagattcatctaacattgcaataaatttaaagctgctttcctctcaaactcataaagaatttgacgcacaagaaagggaacaacaggaaaaaataagtcttatagataaacctgcaatttctaaaagagctgaacatgaatcacctattacatttgacttaaagcagtttcacactcaaataaaacacacagatgtgaaattccaagaattagatagtggtcaaccagaagaagcttattttaaaatccaacatcctgctgacactgagaacattgtatttgatctaaaacaaatgtattctcatataggagatccagctctggagttccaagggcaagaaactagggaacagcaggaaatacattataaagaaaaaattcctagccctgaaacgttacaacctgacacacacaatatctctaaaagtgtgcaaaataatgtatttgccagtcaagaaatttcttccagtcaagagctttcaaatagaactatggtggagaaaagtagtattgatgaaaattccatttctttagaaaaagaagtccgacatgtacaggaacaaaacttagacattttaaaaactgatctttctcttaaatccttttctgaagaaatctatagtgaatcatgtgccctacttccaacctcatctgcagatatagaagaaactgatctttctgagaaaagttgtcctctagaaaatggaggcagaagttccatctcacatttgaaaaaagcagcaagtgaggaaaagcctttaggggttggtgaaatggaagaagaatgcactctagaaccagagttggcagcatttccaaagcaggatggtgggacacaggaatatacagatgccactttggaagaccacagaggtgatgttcaggaagctgacacactccatagacagctctccctgagtcagtgcttcccactcttgatgactgaagaacaacagaatccaggtgaacaaataagtacaaacattcatgcctctggagaagaaaaatgttatgaagaagttcaagttcagaatgaagcttctttctccactttagaaggagaaatgatagaaactagtttttctcaaaatattcctaaattagatgaggcacataccactgaggcagcagaatctgagacctccctaacacaatatttacttgctgctggaaagcgtgaggttcctgaaactaaagacaccagagaccaggcaaagcttgtccagagtgaatcaatcacttcaatggaggtggaagaagtaactttcaacactgtgtatgaatactacaaccagaaacaggaatcactaggtcgtccactttctcctgagtctgacatttccattggtgtgggaagtacaaccagtgaagaaatatctgagttagatcagttttataccccaccatcatctgttgaatattttgaatctccaaagtcccctgacttatattttaatccttcagatataactaaacaatcctcaatacattcaggaggtgagacagttgaaagatattccacacctttaggggaagttgctgaaagatattcaacaccttccgaaggtgaggtaggagaaagatactccacacccccaggggagacactagagagatactccacacctccaggagagactctagagagatactccacacccccaggagagactctagagagatattccacacccccaggagagactctggagagatactccacacccccaggagagactctagagcgatattccacacccccaggggaggcactagagagatattctattcctactggaggaccaaaccccactggtacttttaaaacatatccatcaaaaatagaaatggaagacggtacaccaaatgagcatttctacacacctacagaagagaggggttcagcttatgaaatatggcgttccgattcatttggtacacccaatgaagccattgagccaaaagacaatgaaatgcctccatcttttattgaacctctgaccaaaaggaaggtatatgaaaacacaacactaggcttcattgttgaagttgaaggtcttccagttcctggtgtgaaatggtatcgaaataaatctttactagagccagatgaaagaatcaaaatggaaagagtgggtaatgtgtgttcactggaaatttctaacattcaaaaaggagaagggggagagtacatgtgtcatgctgtaaacatcataggggaagcaaagagctttgcaaatgtagacataatgccccaggaagaaagagtggtggcactaccacctccagtaacacatcagcatgtcatggagtttgatttggaacacaccacatcatcaagaacaccttctcctcaagaaattgtcctggaagttgaattaagtgaaaaagacgttaaagaatttgagaagcaggtgaaaatagtgacagttcccgaatttactcctgaccataaaagtatgattgtgagtctagatgttcttccatttaattttgtagatccaaatatggattcaagggagggagaagacaaagaactaaaaattgatttagaagtatttgaaatgcctcctcgctttataatgcctatttgtgattttaaaattccagaaaattcagatgctgtattcaaatgttcagtcatagggatcccgactcccgaagttaagtggtataaagaatatatgtgtattgagccagataatattaaatacgtgattagcgaggagaagggaagtcacactcttaaaattcgaaatgtctgtctttctgatagtgcaacatacaggtgcagagctgtgaattgtgtaggagaggctatctgtcggggattcctcaccatgggagattctgaaatatttgctgtgatagcaaagaaaagcaaagtgactttaagcagtttaatggaagaattggtcttaaagagcaactacacagacagtttttttgaatttcaggtggtggaagggcctcccaggtttatcaaaggtatttctgactgttatgcaccaataggtacagcagcatattttcagtgcttagttcgtggctctccaagacccacggtttactggtacaaagatggaaaattagtccaaggaagaaggttcactgttgaggaaagtggcacagggttccataacctgtttataacaagcttagtaaagagtgatgaaggagagtataggtgtgtagctacaaacaaatcaggaatggctgagagctttgcagcactcaccttaacttaaaatgtaatgttttagtgcctcagtaattattagcattgatctgagtgctttcatattttccaaattatgtggatctaataaacttccaaacaggtccaccatatttgaattcattaccttggagacccctaaagaaataatctctatgtagaaatctcatctttgtaatacatgtaaatattttgttatctgaactgtggaatcatcacttgtgtcaatcatgctgtgtaatatcaaacacaattaaatctctccttggctacct

SEQ ID NO: 2955 - DNA, 82402 bp, Homo sapiens
agcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcaagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgatttaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatcacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagagtacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaaggatttagcaaatttgaagaaaatacatcaaactcccaatggcatgtctctttatcagtttcatttaagaaggagccccttggccaaaagcccagcttcatccagcctctgtcaagcctcagggtgcacaacggggagacagtcagatttcatgcgagggtttctggcattcccaagccagaaatccaatggtttcataaccagcagctaattctaccaacaaaagatgtagttttccattttgaggagtccacaggcatggctttaatgcttatagttgatgcttactcagagcatgctgggcagtactcttgcaaagcagccaatagtgctggggaagccacttgtgcagctacactcacagtgactccaaaagctcctgaatcaattttgcatgagaggattgaacaagagattgagatggaaatgaaagagttttctagttcttttctgtctgccgaggaagaaggacttcatagcgccgaacttcaattatctaaaataaatgaaacacttgaacttttgtctgaatctccagtttactcaactaaatttgattccgaaaaggaaggcactggcccaattttcatcaaagaagtgtcaaatgctgatataagcatgggggatgtggctacactgtctgtaactgtcattggcatccccaaacctaaaattcagtggttctttaatggagtgctattaaccccttctgctgactacaaatttgtttttgacggtgatgatcatagcctgatcattctgttcaccaaattggaggatgagggagagtatacatgtatggccagtaatgactatggaaagacaatatgtagtgcctatctaaaaattaattccaaaggagagggtcacaaagacactgaaacagaatcagcagtggcaaaatctctggaaaagctgggaggtccttgtcctcctcacttccttaaggagttaaaaccaattcgctgtgctcaagggcttcctgccatctttgagtacacagtggttggagagcctgcccctactgttacatggttcaaagaaaacaagcagctttgcaccagtgtttattacactatcattcataaccctaatggctctggaactttcattgtcaatgaccctcagagggaagacagtggcctctatatctgtaaagcagagaatatgttgggtgagtccacctgtgcagcagagctgcttgtgcttctggaagacacagacatgactgataccccctgcaaagcaaagtccacaccagaggctcctgaggattttccacagacacccttaaagggtcccgcagttgaagcacttgactcagagcaggaaattgcaacgtttgtaaaagacaccattttgaaagctgctttaattacagaagaaaaccagcaactatcttatgagcatattgctaaagccaatgaattgagcagtcagcttcctttgggagctcaggaattgcaatccattttggagcaagacaagctcactcctgaaagcaccagggaatttctttgcatcaatggcagtattcactttcagcctctcaaggaaccatctcccaacctacagctgcagattgtacagtcccagaaaaccttctccaaagaaggtattctaatgcctgaagagcctgagacacaggcagttctatcagataccgagaaaatcttcccaagtgccatgtccatagaacaaattaattcattaacagttgagcctctgaaaactttattagctgaacctgaagggaattatccacagtcttcaatagaacctccaatgcattcttatctaacctctgtggctgaggaagtactttcaccaaaagaaaagacagtatctgacaccaacagagagcaaagagtgactcttcaaaagcaagaggcacaaagtgcgctcatcttgagtcagagcttagctgagggacacgtggagagtctccagagtcctgatgtcatgatctctcaggtaaactatgagcccctagtcccttcagaacactcatgcacagaaggaggtaaaattttgatagaaagtgcaaatccactggaaaatgcagggcaagattctgcggtcagaattgaggaaggcaagtccttaagatttccactagcacttgaagaaaagcaggtactgctcaaagaagagcattctgacaacgtggtgatgcccccagaccaaatcattgagtctaaaagagagcccgtggcaataaagaaagtgcaggaggtacagggaagggaccttctttctaaggaaagcttgctttctggtattccagaagagcagagattaaacctgaaaattcaaatctgccgggctttgcaagcagccgtggccagcgagcagccaggtcttttctctgagtggctaagaaatattgaaaaggtggaggtcgaggctgtaaacatcacccaagagcccagacacatcatgtgcatgtaccttgttacttcggcaaagtctgtaacagaagaagtaaccatcattattgaagatgttgatcctcaaatggctaacctgaaaatggaacttagggatgctttgtgtgctattatatatgaggaaatagacatcctaacagctgagggtcctagaattcagcaaggagccaaaacaagtttgcaagaagaaatggattctttttcaggttcacagaaggttgaacccattactgaaccagaagttgaatctaaatatctgatctcaactgaagaggtcagttattttaacgtgcaaagtagggttaaatatttggatgccacacctgtcactaaaggggttgcttcagctgttgtctctgacgaaaaacaagatgagagtctgaaaccatcagaggaaaaagaggagtcttcctctgaaagtggtactgaggaggttgctacagtaaagatacaggaagctgagggtggcttaatcaaagaggatggccccatgatacatacacctttagtggacactgtttctgaggaaggtgatattgtacacctcacaacatccataacaaatgctaaagaggtgaattggtattttgagaataaactggtgccttcagatgaaaagttcaagtgtttacaagatcaaaatacatatacgctagtcatcgacaaagtaaataccgaagaccatcaaggagagtatgtctgtgaggccttgaatgacagcggaaaaacagcaacttcagccaaactcactgtagtaaaaagagctgccccagtgatcaagaggaaaatcgaacccctggaagtagcactgggccacctagccaaattcacctgtgagatccaaagtgctcccaatgtccggttccagtggtttaaagctggccgagaaatttatgagagtgacaagtgttctattcgatcttcaaagtatatctccagccttgaaatcctgagaacccaggtggttgactgcggcgagtatacatgcaaagcttccaatgagtatggcagtgtcagctgtacagccacactaactgtgacagtgcctggaggtgaaaagaaagttcgcaaattacttccggaacgtaaacctgaaccaaaggaagaagttgttctgaaaagcgttctaagaaaaagacctgaagaagaagaacctaaagtagaacctaaaaaactagaaaaagttaaaaaacctgcagtaccagaaccaccacctccaaaacctgttgaagaggttgaagtacctactgttacaaaaagggaaaggaagattcctgaaccaacaaaagtgcctgaaatcaagccagcaatacctctccctgcacctgaaccgaaaccaaagcccgaagcagaagtgaaaacaatcaaaccacctcctgtggaacctgaaccaacccccatcgctgccccagtaacagtgccagtggttggaaagaaagcagaagccaaagcacctaaggaagaggctgccaagccaaaaggtcctatcaaaggtgtacccaaaaagactccttcaccaatagaagccgaaaggagaaagttaaggccaggaagtggtggagagaaacctcctgatgaagccccgttcacctaccagctaaaggctgtgccactgaagtttgtgaaagaaatcaaagacatcatcttgacagaatcagagttcgttggctcttcagcaatctttgaatgtttggtctccccttccactgcaattacaacctggatgaaagacggtagcaatatccgtgagagtcccaagcacaggtttattgcagatggtaaagacagaaagctgcacatcattgatgttcaactttccgatgctggtgaatacacctgtgttttacgtttgggaaacaaagaaaagacctccacggctaaacttgttgtagaagaacttcctgtgcgttttgtaaaaacactggaagaggaagtcacagtggtcaaaggacagccattgtacttgagctgcgagttaaacaaagagcgtgacgtggtctggaggaaggatggcaagattgtggtggagaaacctggccgaattgtgccaggcgtcattggcttgatgcgggctctgaccatcaacgatgcagatgacacagatgctggaacatacacagttactgtggaaaacgccaacaacctggagtgttcatcttgcgtaaaagtagtagaagtcattagagattggctggtgaaacctatacgagaccagcatgtgaaacccaaggggacagctatttttgcctgtgatatagcaaaagatactccaaacattaagtggttcaaaggatatgatgaaatccctgcggaaccaaatgataagactgaaatactgagagatggaaatcatctgtacctcaaaattaagaatgctatgccagaagatattgctgagtatgcagtggaaattgaaggaaaaagataccctgcaaagctgacacttggagagcgtgaagttgaactgcttaaaccaatagaggacgttaccatttatgagaaagaaagtgcaagctttgatgcagaaatctcagaggcagacattcctggacaatggaaactgaaaggagaacttctaaggccctcacctacttgtgaaatcaaagcagaaggtggaaaacgcttcttaactttgcacaaagtcaaactggaccaagctggtgaagtcctctaccaggcccttaatgcaattacaactgccattttgacagtaaaagaaatcgaacttgactttgctgtgcccctgaaggatgtcactgttccagaaaggcgacaggctcgattcgaatgtgtcctcacccgagaggcaaatgttatatggtccaaaggacctgatataattaagtcatctgacaaatttgatatcatcgctgatggaaagaaacatattcttgttattaatgattctcaatttgatgatgaaggggtctatactgctgaggtggagggcaagaagacctcagctcggttgtttgtcacaggtataagactgaaattcatgtcacctcttgaagatcaaacagtaaaagaaggtgaaacagcaacttttgtttgtgaactttctcatgaaaaaatgcatgtagtctggttcaaaaatgatgccaaactccatacaagcagaacagtactcatctcttctgagggcaagactcacaaattggaaatgaaagaagtgacattggatgatatatctcagataaaagctcaagtcaaggagctgagctccacagcacagctgaaggtcttagaggccgatccctacttcactgtgaaattacatgacaaaactgcagtggagaaggatgagattactttgaagtgtgaagtgagcaaagatgtaccagtgaaatggttcaaagatggtgaagagattgtcccttcacccaaatattctatcaaggcagatggcctgcgccgcatcttaaaaatcaaaaaggcggaccttaaagataaaggcgaatatgtgtgtgactgtggcacagacaagaccaaggcaaatgttactgttgaggctcgactaataaaagtggaaaagcctctgtacggagtagaggtgtttgttggtgaaacagcccactttgaaattgaactttctgaacctgatgttcacggccagtggaagctgaaaggacagcctttgacagcttcccctgactgtgaaatcattgaggatggaaagaagcatattctgatccttcataactgtcagctgggtatgacaggagaggtttccttccaggctgctaatgccaaatctgcagccaatctgaaagtgaaagaattgcctcttatcttcatcacacctctcagtgatgttaaagtcttcgagaaagatgaggctaagtttgagtgtgaagtatccagggagcccaaaacattccgttggctaaaaggaacccaggaaatcacaggtgatgacagatttgagcttataaaggatggcactaagcattcaatggtgatcaagtcagctgcttttgaagatgaagcaaaatacatgtttgaagctgaagataagcacacaagtggcaaactgatcattgaaggaatccggctcaaattcctcacccctctcaaagatgtaactgccaaagagaaggaaagtgctgtatttactgtggagttatctcatgataacatccgagttaaatggttcaagaatgaccagcgcctacacaccaccaggtcggtctcaatgcaagacgaagggaaaactcattcgatcacattcaaagacctgtctattgatgacacctcccaaattagagtagaagctatggggatgagttcagaagctaaactcactgtgcttgagggagacccatattttacaggaaaacttcaagattatactggtgtagagaaagatgaagttattctacagtgtgaaattagcaaagcagatgcaccagtgaaatggtttaaggatgggaaggaaataaagccatccaaaaatgctgttattaaggcagatggcaagaaacgcatgctaatcctaaagaaagccttgaaatcagatattggacagtacacctgtgactgtgggacagataagacctcaggaaaacttgacattgaggatcgggaaattaaactggtgcgacccctgcacagtgtggaggtgatggagactgagacagcacgctttgaaaccgaaatctctgaagatgatatccacgccaactggaaactcaagggagaggccctactccaaacacctgattgtgaaattaaggaagaaggcaaaatacactcccttgttttgcacaactgtcgcctggaccagacgggtggggtggatttccaagctgccaatgttaaatctagtgcccacctccgagttaagccacgagtaattggtcttctgaggcctttaaaggatgtcaccgtgactgcaggggaaacagccaccttcgactgcgagctctcctacgaagatatcccagtggaatggtatctcaaagggaagaaactagagcccagcgataaggtggtcccacgttcagaaggaaaagttcatacacttactctgagggatgtaaagttagaagatgctggggaagtccaactaacagcaaaagatttcaaaactcacgccaacctctttgtgaaagaacccccagttgaattcactaagcctcttgaggaccagacggtcgaagagggagccactgcagtgctggagtgtgaagtctccagagaaaatgctaaggtgaaatggttcaaaaatgggacagaaatcctcaaaagcaagaagtatgaaattgttgctgatggcagggtcagaaaacttgttatacatgactgtaccccagaggatattaaaacatacacttgtgatgctaaggattttaagacttcctgtaacctgaatgtcgtgcctcctcatgtggaattcttaagaccactcaccgaccttcaagttagagaaaaagaaatggctcgatttgagtgtgaactttcccgagaaaatgctaaggttaagtggtttaaagatggtgctgaaattaaaaagggcaaaaaatatgacatcatatccaagggagcagtgcgcattcttgtcatcaacaaatgtctactggatgatgaagctgaatattcctgtgaagtaaggacagcgagaacttctggcatgctgacagttctggaagaagaagctgtctttaccaaaaatcttgccaacattgaagttagtgaaacagacactataaaactggtttgtgaagtctccaaacctggcgcagaagtgatttggtataaaggggatgaggagatcattgaaacaggaagatatgaaatactgactgaaggacggaagagaatcctggtcattcagaacgctcaccttgaggatgctggcaactacaactgtcgactcccaagctctcgaaccgatggcaaagtcaaagtacatgaactggctgctgaatttatctcaaagcctcaaaaccttgaaatacttgaaggagaaaaggctgaatttgtctgctctatatcaaaagaaagctttccagtccagtggaagagggatgataagacacttgaatctggagataaatatgacgttattgctgatggtaaaaagagggtcctagttgtgaaagatgccacattacaagatatgggcacttacgttgtcatggtaggggccgccagagcagcagctcacttgacagtcattgaaaaactcaggatcgtagttcctcttaaggacacccgggtgaaggaacaacaggaagttgtcttcaactgtgaagtcaatactgaaggtgccaaagccaaatggttcagaaatgaagaagctatatttgatagttcaaaatacatcattctccaaaaagacctagtctacaccctcagaattagagatgcacacttagatgaccaagccaactataatgtgtctttgaccaatcacagaggtgaaaatgttaaaagtgcagccaatctaatagtagaagaggaagaccttaggattgttgagcctcttaaagatattgaaacaatggagaagaaatctgtcacattctggtgcaaggtgaatcgtctcaatgtaacactgaagtggaccaaaaatggtgaagaagtgccttttgacaaccgtgtctcatacagagttgataagtacaagcacatgttaaccattaaagactgtggcttcccagatgaaggtgaatacattgtcactgctggacaagataaatctgttgctgagcttctcatcatagaagccccgacagaatttgtggaacacttggaagatcagacagtcactgagttcgatgacgctgtcttctcctgccagctctccagagagaaagccaatgtaaaatggtacagaaatgggagagaaatcaaagaaggcaaaaaatacaaatttgaaaaagatggaagtatacacagactcattataaaagattgcaggctggatgatgagtgtgaatatgcttgcggggtagaagacaggaagtctcgtgctagactttttgtggaagaaattcctgttgagatcatcaggcctccacaagatattcttgaagcccctggtgctgatgttgtctttttagcagaactcaataaagataaggtggaagtccaatggctaagaaataacatggttgttgtccagggtgataaacaccagatgatgagtgaaggaaagatacatcgactacagatttgtgatattaagccccgtgaccagggtgaatacagatttattgccaaagacaaagaagccagagctaagcttgaactggcagctgcaccaaaaatcaagacagctgaccaagaccttgtggttgatgttggcaagcctctgacaatggtggtgccatatgatgcctaccccaaagcagaagctgaatggtttaaagaaaatgaacctttatctacaaaaaccattgatactacggctgaacaaacttctttcagaattttagaagccaagaaaggagacaaagggaggtataaaattgtgcttcagaacaaacatggaaaagcagaaggattcatcaatttaaaagttattgatgttcctgggccagtacgtaacttagaagtgacagaaacatttgatggtgaagtgagccttgcttgggaagaacctttaactgatggtggaagcaaaatcataggttacgttgttgaaagacgtgacattaagagaaagacctgggttctggccacagaccgtgcagagagttgtgagtttactgtcactggtctacagaaaggaggagttgagtacctattccgtgtgagtgcaagaaacagagttggcactggtgagccagtagaaactgacaatcctgtagaagcaaggagtaaatatgatgttccaggccctcctttgaatgtaaccatcactgatgtgaatcgatttggtgtctcactgacatgggaaccaccagagtatgatggaggtgctgagatcacaaactacgtcattgaattaagagacaagacttctatcaggtgggatactgccatgactgtgagagctgaagacctgtctgcaactgttactgatgtggtagaaggacaggagtacagtttccgagtgagagcccaaaatcgaattggagttggaaaaccaagtgcagccacacccttcgtcaaagttgctgatccaattgagagaccaagtcctcctgtaaacctaacttcctcagatcagactcagtcatcagttcagctcaaatgggaacctcctctgaaagatggaggaagcccaatattaggctatataattgagcgatgcgaagaaggaaaagataattggattcgttgcaatatgaaacttgtccctgaactgacttacaaggttaccggattggaaaaaggaaataaatatttatatagagtatctgcagaaaataaagctggtgtttcagatccatctgaaattcttggtcctctcaccgctgacgatgcatttgttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattgctcgcccaagtgcacccaaagaattgaaatttggtgatataaccaaggactcagtacatttgacttgggaaccacctgatgatgatggaggaagtccgttaactggatacgttgttgaaaaacgagaagtcagccggaaaacatggactaaagttatggactttgtgactgatctagaattcacagttcctgatcttgttcaaggaaaagagtacttatttaaagtttgtgctcgtaacaaatgtggccctggagaacctgcatatgttgatgaacctgtaaatatgtcaactcctgcaacggtacctgacccaccagagaatgttaaatggagagatcgaacagccaatagcatcttcttaacatgggatccacctaaaaatgatggtggttcacgcatcaaaggatatatagttgaaagatgtccacgtggttctgataaatgggttgcctgtggagaacctgttgcagaaacaaaaatggaagtgacaggtcttgaggaaggcaaatggtatgcctaccgcgtgaaggccttaaacaggcagggtgctagcaaaccaagcagacccacagaggaaatccaggctgtggacacacaagaggccccagaaatcttcctcgatgtgaagctccttgctggtctcactgtaaaagctgggaccaagattgaacttcctgccaccgtaaccggaaaacctgaacctaaaataacttggacaaaggctgatatgattctgaagcaggacaaaagaattaccattgaaaatgtccctaagaaatccacagtgactattgttgatagtaagagaagtgacactggcacatatatcattgaggctgtgaatgtgtgtggccgggccactgctgtggtggaagtgaacgtcttagataaacccggaccaccagctgcctttgacatcacagatgtaaccaatgagtcatgtcttctaacatggaacccaccacgcgatgatggtggatctaagatcacaaactatgttgtggagagacgagcaactgatagtgaagtgtggcacaagctctcatccaccgtcaaggatacaaacttcaaggccaccaaattaatccccaataaagagtacatcttcagagttgctgcagaaaacatgtatggtgttggtgaaccagttcaggcctctccaataacagccaaatatcagtttgatccacctggtcctccaactcgcctagaaccttctgatatcactaaagacgcagtgactctcacatggtgtgagccagatgatgatggtggcagcccaatcacaggatactgggttgaaagactggatcctgatacagataaatgggttagatgcaataagatgccagtaaaggacacaacatacagagtgaaaggtctcactaataagaaaaaatacagattccgtgtgttggctgaaaatcttgctggacctggaaaaccaagcaaatcaactgaaccaatcttaataaaggatcccatagatcctccatggccccctggaaaaccaactgtaaaagatgtaggcaaaacatcagtaaggttgaattggacaaaaccagaacatgatggaggtgcaaagattgagtcttatgtcattgaaatgctgaagactggaacagatgagtgggtcagagtggcggaaggggttcccaccactcagcacttgctcccagggctcatggaaggacaggaatactcattccgagttagagctgtgaataaggctggggaaagtgaacccagtgaacccagtgaccctgtgctttgccgggagaagctatatcctccatcaccaccacgctggcttgaagttattaatatcacaaaaaatacagcagacctaaaatggacagttcctgagaaagatggagggtcccccatcaccaactacattgtggaaaagagagacgtcaggcgaaaaggctggcaaacagtggataccactgtcaaggacaccaagtgcacagtcaccccactgactgagggctctttatatgtgttccgagttgctgcagaaaatgctataggacaaagcgactacaccgaaattgaggactctgtgctggccaaagacacctttaccactcctggaccaccctacgccctggcagtggttgatgtgacaaaacgacatgttgacctaaagtgggagccacctaaaaatgatggtggaagaccaatacagagatatgtcattgagaagaaagaaaggttaggtacccgttgggtgaaagctggaaagactgcaggacctgactgtaacttcagagtaactgatgtcatcgaaggaacagaggtccagtttcaggttcgggctgaaaatgaagctggagttggccacccaagtgaacccacagaaatcctatccattgaagatccaacaagtcctccctcaccaccccttgacctacatgtgactgatgctgggagaaaacacattgccattgcttggaagcctccagagaaaaatggtggaagtcctatcataggataccatgttgaaatgtgtccagtaggcactgagaaatggatgagagttaattctcgcccaataaaggacttgaaattcaaggttgaagaaggtgttgttcctgacaaagaatatgtcctgagagtgagagcagtcaatgctattggtgtcagcgagccatctgaaatctctgaaaatgtggttgccaaagacccagactgcaagccaacaattgacctggagactcatgacattattgttattgaaggtgaaaagttaagcattcctgttcccttcagagctgtcccagttccaactgttagttggcataaagatggcaaagaagttaaagcaagtgatagattaacaatgaagaatgatcacatctctgcacaccttgaagttcccaagagtgtccgtgcagatgccggaatttataccattacactggagaataagctcggctcagcaacagcctcaatcaatgtcaaagtcataggcctacctggaccatgcaaagatattaaagcaagtgacattaccaagagttcttgtaagttaacttgggaacctccagaatttgatggtggaaccccaattcttcattatgtcctggagcgcagagaagctgggaggagaacatatataccagtcatgtctggtgagaacaaactgtcatggactgtgaaggatctcataccaaatggtgaatacttcttccgtgttaaagcagtcaacaaggttggtggaggagaatatattgaactgaaaaatccagtcattgctcaagatccaaagcaaccccctgatccacctgtagatgtagaggttcataatcctacagcggaggcaatgactattacatggaagccacctttgtatgatggagggagcaagataatgggctacatcatagagaagattgctaagggtgaagaaaggtggaagagatgcaatgaacacctggtaccaatcctgacctatacagcaaaaggacttgaagaggggaaagagtaccaattccgtgtgcgagcagagaacgccgcgggtattagtgaaccttctcgggctactcctccaaccaaagctgtagatcccattgatgcccccaaagtcattctgagaacaagcctagaagtgaaacgaggtgatgaaatagcacttgatgcaagtatttctggatcaccttacccaactattacatggataaaggatgaaaatgttattgtaccagaggaaattaagaagcgtgcagcacccttggttaggagaaggaagggtgaagttcaagaagaagaaccatttgtcctgcctctgacacagcgtttgagtattgacaacagcaaaaagggagaatctcagctacgcgtccgagattctctccgacctgaccatggtctgtatatgatcaaagttgaaaatgaccacggtattgcaaaagctccttgtactgtcagtgtgttagatacaccgggaccaccaatcaactttgtatttgaagatatcagaaagacctcagtcctttgtaaatgggaaccaccccttgatgatggtggcagtgaaatcataaactacactttggaaaagaaagacaagacaaaacccgactcagaatggattgttgtcacttcaacacttagacattgcaaatattcagtaacaaaactgattgaaggaaaagagtacctcttccgtgtaagagctgaaaacagatttgggccaggtccaccatgtgtttcaaagccacttgtggctaaagatccatttggaccacctgatgcaccagataagcccattgtggaagatgttaccagcaacagtatgctagtgaaatggaatgaaccaaaagataatggaagccccattttgggttactggcttgaaaaacgtgaagttaacagtacacattggtctcgtgtcaacaaaagccttctgaatgccttgaaagccaatgtagatggcttattagaaggactcacctatgtcttcagagtatgtgctgaaaatgcagctggacctggaaagttcagtccaccttcagatcccaaaacagcacatgatccaatctctcctcctgggccacctatcccaagagtcactgacacaagctctacaactattgaactagaatgggaacccccagctttcaatggtggtggggaaattgttggctattttgttgataagcagttggttggcacaaatgaatggtcacgctgcacagagaagatgatcaaggtccgtcagtacaccgtcaaagaaatccgagagggtgctgattacaaacttcgggtgagtgctgtcaatgccgcaggggaaggaccgcctggagaaacacaacctgttactgtggctgaaccacaagagcctccagctgtggaactggatgtttctgtcaagggtggaatacaaataatggctgggaagactcttagaattccagctgtggtgactggtcgccctgtacctacaaaagtatggaccaaagaagaaggggagctggataaagaccgtgttgtaatagacaacgttggaaccaaatctgaactaattatcaaggatgcactgcgaaaagaccatggcagatatgtgattacagctacaaatagctgtggttccaaatttgcagcagccagggtagaagtttttgatgtccctggtccagttcttgacttaaaacctgttgtaacaaacagaaaaatgtgtctacttaactggtctgatccagaagatgatggaggaagtgaaataacaggctttatcattgaaagaaaagatgccaagatgcatacttggagacaaccaatagagactgagagatctaaatgtgacatcacaggtctgcttgagggacaagaatataagttccgtgttattgccaagaacaagtttggctgtggccctcctgttgaaataggaccaattcttgcagttgatccactaggtcctccaacatctccagagaggctcacatacactgaaaggacaaagtccactatcacacttgactggaaagagccccgcagtaatggtggcagtcccatccaaggatatatcattgaaaaacggcgtcatgacaaacctgactttgaaagagttaacaagcgactctgcccaaccacatcttttctggttgaaaatcttgatgaacaccaaatgtatgagttccgtgtcaaagctgtcaatgaaattggtgaaagtgaaccatccctacctcttaatgtagtcatacaagatgatgaagtgcctccaactattaagttgcgtctgagtgttcgaggagacactatcaaagttaaggcaggagagcctgtccacatccctgcagatgtgacaggccttccaatgcctaagattgaatggtccaaaaatgaaactgtaattgaaaaacccactgatgcacttcagataaccaaggaagaggtatcccgaagtgaggcaaaaactgagcttagcattcccaaagcggtccgggaggacaaaggcacttacacagttactgcttccaatcgccttggctcagtgttccgaaatgttcacgttgaagtatatgaccgcccatccccaccaagaaatcttgctgttactgacattaaagctgaatcttgctacttgacatgggatgcccctcttgataatggtggcagtgaaatcacccattatgttattgacaaacgtgatgcaagtaggaagaaagcagaatgggaggaagtcaccaacactgctgtagagaaaagatatgggatctggaaacttatccccaatggtcagtatgagttccgagtcagggcagtgaataaatatggaatcagtgatgagtgcaaatcagataaagtagtcattcaagatccttatcgccttcctggacctccaggaaaaccaaaagttttggcacgcaccaaaggatcaatgctagtgagctggactcctcctttggacaatggtggctctccaattactggctactggctggagaaaagagaagagggaagtccttattggtcacgtgttagccgagcaccaataaccaaagtgggattgaaaggcgtggaatttaatgttcctcgtttgcttgaaggcgttaaataccagttcagagccatggcaataaatgctgcaggaattggtcctcccagtgaaccatcagatccagaggttgcaggagatcccatatttccaccggggccaccttcttgcccagaagttaaagataaaacgaagtcaagcatctcactaggatggaaacctccagccaaagatggtggcagcccaatcaaaggatacattgtagaaatgcaagaagaaggtactactgactggaaaagagtaaatgaaccagacaaacttataactacctgtgaatgtgtggtgcctaatctgaaagagctcaggaagtacagattcagagtgaaagctgtcaatgaagctggtgaatctgaaccaagtgatacaactggggagatccctgccactgatattcaagaggaaccagaagttttcattgacattggagcacaggactgtctggtttgtaaagctggctcacagattaggattcctgctgtcatcaagggacgcccaacaccaaaatcatcttgggaatttgatggaaaggcaaagaaagcaatgaaggatggagttcatgacatacccgaagatgcacagctggagactgctgaaaactcctcagtaattattattccggagtgtaaacgatctcatacaggcaaatacagcatcacagccaagaataaagcaggacaaaagactgcaaattgcagagttaaagtcatggatgtaccaggcccacccaaagatctgaaagtcagtgatatcacaaggggtagttgcagactttcatggaagatgccagacgacgatggaggagacaggatcaaaggctatgttattgagaagaggactattgatggaaaagcctggaccaaagtcaatccagactgtggaagcaccacatttgtagtgcctgatctcctctctgaacagcaatatttcttccgtgtgcgagcagaaaaccgttttggtattggcccacctgtggaaaccattcagaggaccactgccagagatccgatatatcctcctgatcctcctattaaactcaagattggcctcatcacaaagaacacagtgcatctgtcatggaaacccccgaagaatgatgggggctcccctgttacccactatattgttgagtgccttgcatgggaccctactgggacaaagaaagaagcctggaggcagtgcaataagcgtgatgtggaagaactgcaatttactgttgaagacctagtagaaggtggggaatatgaattccgagtcaaagctgtcaatgctgcaggagtcagcaagccttcagccactgttgggccctgtgactgtcaaagaccagacatgccaccatcaattgatctaaaagaattcatggaggttgaagaaggaaccaatgttaacattgtggccaaaattaaaggtgtgccattcccgacactaacctggtttaaagctcctccaaagaagcctgataacaaagaacctgttctctatgacacccatgtcaacaaactggtggtagatgatacttgcactttagttattccgcagtctcgcaggagtgacactggcttatataccatcacagctgtaaataatctgggaacagcatcaaaggagatgagactgaatgtcctgggtcgtcctggccctccagtgggacccataaaatttgaatctgtttcagcagatcaaatgacactatcttggtttccacctaaagatgatggtgggtctaagattacaaactatgtaattgagaaaagagaagctaacaggaagacatgggtccatgtctccagtgaacctaaggagtgcacgtacacgattcccaaattgctagaaggccatgaatatgtattccgaatcatggcccagaataaatatggcattggagaacctcttgacagtgaacctgaaacagcaagaaacctcttctctgtccctggagcaccagataaaccaacagttagcagcgtgactcgtaactccatgactgtcaactgggaagagccagaatatgatggaggctctcctgtgacagggtactggctggaaatgaaagacaccacttcaaagagatggaagagagttaaccgagatcctatcaaagccatgactttgggtgtttcttataaagtgactggtcttattgaaggttccgactatcaattccgggtatatgcaatcaatgctgctggcgtgggtccagcaagtctgccatcagacccagcgactgctagagatccaattgcccctcctggtcctccatttcccaaagtgacagattggactaaatcatctgcagatctggagtggtctcccccactaaaagatggtggatccaaagtaactggatacatcgttgaatataaagaagaaggaaaagaagaatgggaaaagggtaaagataaagaagtgagaggaacaaagctcgttgtgacaggattaaaggaaggagcattctacaaatttagagttagtgcagtcaacattgctggcattggagaacctggagaggtcacagatgtcattgaaatgaaggacagacttgtttcacctgaccttcagctagatgccagtgtcagagatagaattgttgtccatgctggaggggtgatccgaatcattgcctatgtgtctggaaagcctcctccaaccgtcacctggaacatgaatgaaagaaccttacctcaagaagccaccattgagaccacagccattagctcatccatggtcatcaagaactgccagaggagccatcaaggcgtctattctcttcttgccaaaaatgaagccggagaaagaaagaagacaattattgttgatgtattagatgttccaggtcccgttggaacaccattcctagctcacaacctaaccaatgagtcctgcaaactgacatggttttctccagaagatgatggaggctctccaatcaccaattatgtcattgaaaagcgtgaatctgaccgcagagcatggaccccagtgacatatacagttacccgacaaaatgctactgtccagggtctcattcaaggaaaagcctactttttccgaattgcggctgaaaatagtattggcatgggtccatttgttgagacatcagaggcacttgttatcagagagccaataactgtaccagagcgtcctgaagacctggaagtcaaagaagttactaaaaatactgtaactttgacttggaatcctcctaagtatgatggtgggtcagaaattattaactatgtcctagaaagtcggctcattgggactgagaagttccacaaagttacaaatgacaacttgcttagcagaaaatacactgttaaaggcttaaaagaaggtgatacctatgagtaccgtgtcagtgctgtcaacattgttggacaaggcaaaccatcattttgcaccaaaccaattacttgcaaggatgagctggcacccccaacgcttcacctcgacttcagagataagctcacgattcgagttggtgaagcttttgccctcactggccgttactcaggcaaaccaaagcctaaggtttcctggttcaaagatgaagctgatgtgctggaagatgatcgcactcatataaagactacaccagcaacacttgctttagagaagatcaaggccaaacgttcagattccggcaaatactgtgtggttgtggagaacagtacaggctctaggaaaggtttctgtcaagttaatgttgttgaccgtcctggaccaccagtaggaccagttagttttgatgaggtgaccaaagattacatggttatctcttggaagcctcctttagatgatggaggcagtaaaatcaccaattatattattgagaagaaggaagtgggtaaagacgtctggatgccagtgacatctgcaagtgctaaaacaacatgcaaagtttctaaactacttgaaggaaaagattatattttccggatacatgctgaaaatctgtatggaataagtgatcctctggtgtctgattcaatgaaagccaaagatcgtttcagggttcctgatgcacctgatcagccaattgttacagaagttaccaaagactctgcattagtaacctggaataagccacatgatggaggaaaacccatcacaaactacatcctggaaaagagagaaactatgtctaaacgatgggctagagttaccaaagatcctattcatccatacactaaatttagggttcctgatcttctagaaggatgtcagtatgaattccgggtttctgcagaaaatgaaattggtattggagatccaagcccaccatccaaaccagtctttgctaaagatccaattgctaaaccaagtccacctgttaatcctgaagcaatagatacaacatgcaattcagtcgatctaacttggcagccaccacgtcatgatggtgggagcaagattctgggttatattgttgagtaccagaaagttggagatgaagagtggagaagagccaatcacacccctgagtcatgtcctgaaactaaatataaagtcaccggtcttcgggacggtcaaacctataagtttagagtgttagcagtcaatgcagctggtgaatcagatccagctcatgttccggagccagtcctagtaaaagacaggcttgaaccccctgagttgattcttgatgccaacatggcaagagaacaacacattaaagttggtgatactctaagacttagtgccatcatcaaaggagtgccattcccaaaagtaacttggaaaaaagaagacagagatgctccaactaaagcaagaattgatgtgactccagttggtagcaagcttgaaattcgtaatgctgcccatgaagatggtggaatttattctttaacagtggagaatccagctggttcaaaaactgtctcagtaaaagtacttgtattagataaacctgggccacctagagatctggaagtcagtgaaattaggaaagattcatgttaccttacttggaaagaaccactggatgatggtggttctgttattaccaattatgtggttgagaggagagatgttgccagcgcccagtggtcacctctctcagctacatcaaagaaaaagagtcacttcgctaagcatctgaatgaaggcaaccagtacctcttccgagtagctgcggagaaccagtatggacgtggtccttttgttgaaacaccaaaaccaatcaaggctttggatcctctccatcccccagggccacccaaggacctgcaccatgtagatgttgacaagactgaagtctccctagtctggaataagccggatcgtgatggtggttctccaatcactggatatttggtagaatatcaagaagaaggcacccaggactggattaaatttaagactgtgacaaacttagagtgtgtggttactggactacaacaaggaaagacctatagattccgtgtaaaagctgaaaacattgtgggtcttggtctccctgacacaactatcccgatagaatgtcaagaaaaactagtgcctccatccgtggagctagatgtgaaattaattgaaggtcttgtggtaaaggctggaaccacagtcagattccctgctattataagaggtgtgcctgttcctactgcaaagtggacaaccgatgggagtgagattaaaaccgatgagcactacacagttgaaacagacaacttctcatcagtacttaccattaagaactgcttaaggagagacactggggaatatcaaatcacagtttccaatgcagccggtagcaaaacagtagccgtacatcttactgttcttgatgttcctgggccaccaacaggtcctattaatattctggatgttactcctgaacacatgactatctcatggcagccacctaaggatgatggaggaagccctgtgataaattatattgttgagaaacaagatacaaggaaagacacgtggggtgttgtctcttccggaagcagtaagacaaagctgaaaatcccacatctgcagaagggctgtgaatatgttttccgagttagagcagagaataagataggtgttggtcctccccttgactccacacctactgttgctaagcataaatttagtcctccgtctcctcctggtaaaccagtggttactgacattactgaaaatgcagcaacagtgtcttggaccctgccaaaatctgatggtggcagtccaataactggctactatatggaacgtcgagaagtaactggcaaatgggtgagggtcaacaaaacacctatcgctgacctgaagttcagagtgactggactctatgaaggaaatacatatgagtttagagtttttgctgaaaatcttgcaggactaagcaaaccatccccaagttctgatccaataaaagcttgccggcccatcaaaccacctggaccacctattaatcctaaactgaaagacaagagcagagaaacagctgatttggtgtggacaaagcctctcagtgatggtggtagccccattctaggatatgtagtggaatgtcagaaacctggcacggcacaatggaacaggattaataaagatgaactcattaggcaatgtgcctttagggtacctggactaattgaaggaaatgagtacagattccgtataaaggcagctaatattgtaggagagggtgagccaagagaactagcagaatctgtgattgcaaaagatatccttcatcctccagaagtagaacttgatgttacttgtcgtgatgttattaccgtgagagtaggccaaactatccgcattctagctcgagtcaaaggcagacctgaaccagacataacttggactaaggaaggcaaagtattggtccgagaaaagagggtggaccttattcaggatctacctcgtgttgagttacaaattaaagaagctgttagagctgatcatggcaagtatatcatctcagctaagaacagcagtggacatgcccaaggttcagccatcgttaacgtccttgacagacctgggccttgccagaatttgaaggttaccaatgtaaccaaagagaactgtacaatttcttgggaaaacccactagataatggtggctcagaaataacaaacttcatagtagaatatcgcaaaccaaaccagaaaggctggtcaattgttgcatcagatgtcactaaacgattaatcaaggccaaccttttagccaacaatgaatactatttccgagtttgtgcagagaataaagtaggtgttgggccaaccatcgaaacaaaaactcccattctggctattaaccctattgacagaccaggtgagcctgaaaaccttcacattgcagataaaggaaagacatttgtctatctaaagtggcggaggcctgactatgatggtggcagtccaaatctgtcatatcatgttgagagaaggcttaagggctccgatgactgggaaagagtgcataaaggaagcattaaagaaactcactacatggttgacagatgtgttgaaaaccagatttatgagttcagagtgcaaacaaagaatgaaggtggggaaagtgactgggtgaagacagaggaagttgttgtgaaagaagacttacaaaaaccagtacttgatctgaaattaagtggggtcctaactgtcaaagcaggggacaccattaggcttgaggcaggggttagaggcaaaccattcccagaagttgcatggaccaaggacaaagacgctacagacttaacaagatcaccaagggtcaagattgatacccgtgctgattcatctaaattttctcttactaaagcaaagcgaagtgatgggggtaaatatgtagttacggcaactaacacggctggcagttttgtggcctatgccactgtcaatgttttagataagcctggtcctgtgagaaatctgaaaattgttgatgtgtccagtgataggtgtactgtttgctgggatccaccagaagatgatggtggctgtgaaatccaaaattatattctagaaaaatgtgagacaaagcgaatggtttggtctacctattctgctactgtcttgacacctggtactacagtaacacgtctcatagaaggaaatgaatatattttcagagtccgtgcagaaaataaaataggcacagggcctccaacagaaagtaaaccagtcatagccaaaaccaagtatgataaacctggtcgccctgatcccccagaagtcactaaagtaagcaaagaagagatgactgtggtttggaatccacctgaatatgatggtggaaagtctataactggatactttttggagaaaaaggaaaagcattcaacacgatgggtccctgtcaacaagagtgcaatccctgagagacgtatgaaagtacagaatctcctcccagaccatgaatatcagttccgtgtcaaggcagaaaatgaaattggaattggagaaccaagcttgccttcaagaccggtggtggcaaaagaccccatagagccacctggtccaccaaccaatttcagagtggttgatacaaccaaacattccataactcttgggtggggaaaaccagtctatgatggtggtgcaccgatcattggatatgttgtggaaatgagaccaaaaatagcagatgcgtctcctgatgaaggctggaaacggtgtaatgctgcagcacagcttgtacgcaaggaattcactgttaccagcttggatgaaaaccaggaatatgagttcagggtgtgtgcccaaaaccaagttggtattgggcgccctgcagagctaaaggaagctatcaaacctaaagaaatactagaacctccggagattgatttggatgccagcatgaggaaactggtcatagtgagagcaggatgccctattcgtctctttgctatagtgagaggacgaccagcccctaaagtcacttggcgaaaagttggcattgataatgtggtcagaaaaggacaagttgatctggttgacactatggccttccttgtcatccccaattctacccgtgatgactcaggaaaatattccttaacacttgtgaacccagcaggagaaaaggctgtattcgtaaatgtcagagtattagacactcctgggcctgtgtctgatttaaaagtttcagatgtcactaaaacatcatgccatgtgtcctgggcccctcctgaaaacgacggtgggagccaagtgacacattatatcgtggagaaacgtgaggcagacagaaagacatggtcgaccgttaccccagaagttaagaaaacaagcttccatgtaaccaatcttgtccctgggaatgagtattacttcagagtaactgctgtcaacgaatatggccctggcgtcccaacagatgtcccaaaaccagtgcttgcatcagatcctctaagtgagccggatcccccaaggaaattagaagtgactgaaatgaccaagaacagtgccaccttagcctggttacctcccctacgtgatggaggtgctaaaatcgatggctacatcactagttacagagaagaagagcagcctgcagatcgctggacagagtactcagtggtaaaagatctgagccttgttgtcactggcctaaaggaaggaaagaaatacaaatttagagtagcggccagaaatgctgttggagtcagtttgccaagagaagctgaaggagtgtatgaagccaaagaacaactgttgccaccaaagatccttatgccagagcaaataactatcaaagctgggaaaaaactccgaattgaagcccatgtgtatggaaagcctcatcccacctgtaaatggaaaaaaggagaagatgaagttgtcacatccagccacctggcagtgcataaagcagacagctcttcaattctgatcataaaagatgtgactaggaaagacagtggttactacagcctcacagcagagaacagttctgggacagacactcagaaaatcaaagttgtagtcatggatgcccccggcccccctcagcctccatttgacatttctgatatagacgctgatgcttgctccctgtcatggcacatccctctggaggacggaggcagtaacatcaccaattatatagtggagaagtgtgatgtaagccgaggtgactgggtcacggctctagcttcagtcacaaaaacttcctgcagggttggaaagctgatcccaggccaggagtacatcttccgggtccgtgctgaaaaccgatttggcatttcagagcctctcacatctccaaagatggttgcgcagttcccatttggtgttcctagtgaaccaaagaatgcacgagtcaccaaagtcaacaaggactgtatttttgttgcttgggacagaccagatagtgatggagggagccccattattggttatctgattgaacgcaaggaaagaaacagtttgctgtgggtgaaagccaatgatactcttgtccggtcaactgaatatccttgtgctggccttgtagaaggtcttgagtattcattcagaatctatgccctaaacaaagctggatccagcccacccagcaaacccacagaatatgtaactgcaagaatgccagttgatcctcctgggaaacctgaggttattgatgtcaccaagagtactgtatctctgatctgggctcgtccaaagcatgatggaggcagtaaaattattggctatttcgtagaagcttgcaaacttcctggtgataaatgggtacggtgcaatactgcacctcaccagattccccaggaagagtacacagctactggcctagaagagaaagctcagtatcaatttagagctattgccaggaccgcggtaaacattagcccaccttctgaaccttctgatccagtgactatcctcgcagaaaatgtccctcccaggatagacctgagtgtggctatgaaatctttgcttactgtgaaagctggaactaatgtctgcttggatgctactgtttttggtaaaccgatgccaacagtttcttggaaaaaagatggcacactgctaaaaccagcagaaggcataaagatggccatgcagcggaatctgtgcaccttggagctattcagcgtgaaccggaaggactcaggagactataccattactgctgaaaattcaagtggttctaaatcagccaccattaagcttaaagtgttagataaaccgggtcctccagcatctgttaaaatcaacaaaatgtattcagatcgtgctatgctttcttgggaaccgcctcttgaagatggaggctcagaaatcaccaactatattgttgacaaacgtgaaacaagcaggcccaactgggctcaagtctctgcaactgtgcctatcaccagctgcagcgtggagaaacttatagagggccatgagtatcagttccgtatttgtgctgaaaataaatatggagtaggcgatccagtcttcactgaaccagcaattgccaaaaacccatatgacccaccaggacgctgtgatcctcctgttattagcaacataaccaaagatcacatgacagtcagctggaagccaccagcagatgatgggggctcacccatcactggctatttgcttgaaaagcgggaaacccaggctgttaactggactaaggtcaacagaaaacctattatagaaagaacattaaaagcaacaggtcttcaagaaggtaccgaatatgagttccgtgttacagctataaataaagctggaccaggcaaacccagtgacgcatccaaggccgcttatgctcgggaccctcagtatcctcctgcgccaccggctttccctaaagtatatgatacaactcgcagctctgtgagtctatcttggggcaagccagcctatgacggcggcagccctatcattggttatctcgttgaagtaaaacgggctgactccgataactgggtgaggtgcaacttaccacagaatctacagaaaacccgctttgaggttactggcctgatggaagacacacaatatcaattccgtgtgtatgccgttaataagattggatacagtgaccccagtgatgtgccagataaacactatcccaaggacatcttaattccacctgagggagaacttgatgcggacttaaggaagacactcatattacgtgctggagttactatgagactatatgtaccagtaaaaggacgcccacctccaaagattacttggtctaaaccaaatgtcaatctaagagacaggattggactggacataaagtcaactgactttgacactttcttgcgctgtgaaaatgtgaacaaatatgatgcaggaaaatatatcttaaccctggagaacagctgtggtaaaaaggaatataccattgttgtgaaagtgcttgatactcctgggccacctgtcaatgtgactgttaaggaaatatccaaagactctgcttatgttacctgggagcctcccattattgatggcggaagccccatcataaactatgtggtacaaaaacgtgatgcagagaggaaatcctggtctacagtgacaactgagtgctccaaaacaagcttcagagtagctaatttggaggagggaaaatcctacttcttccgagtgtttgctgaaaatgagtatggcattggtgatcccggtgaaactcgtgatgctgtcaaagcttcccaaactcctggaccagttgtggacctgaaagtgaggtctgtatctaagtcatcctgtagcattggctggaaaaagcctcacagtgatggtggaagtcggattattggatatgtagttgatttcctgactgaagaaaataagtggcaacgagttatgaaatccttaagcctacagtactctgcaaaagatttgactgaagggaaggaatataccttcagagtgagtgctgagaatgaaaatggagaaggaaccccaagcgaaatcactgttgtggcaagggatgatgttgtggctcctgatcttgacttaaagggtctacctgatttgtgctacttggctaaagaaaacagcaacttccggcttaagatccccataaaaggcaagccagctccatcagtctcctggaagaaaggggaagatcctctagcaactgacactagagtcagtgttgagtcatctgcggttaacacaactcttatagtgtacgattgccaaaaatctgatgctggaaaatacacaatcacacttaagaatgttgctggcaccaaggaaggaactatctccataaaggttgttggcaagcctggcatccccactggaccaatcaaatttgatgaagtcacagcagaagccatgaccttaaagtgggctcctccaaaggatgatggaggttctgaaatcaccaactatatcctagagaagagggattctgtgaacaacaagtgggtgacgtgcgcctcagctgtccagaaaaccacctttagagtaaccagacttcatgagggcatggaatataccttcagggtcagtgccgaaaataaatatggtgtaggggaaggcctgaaatcggagccaattgttgcgagacatccatttgatgtgcctgatgctcccccacctcccaatattgtggatgtcagacacgattcagtatctctaacttggactgaccccaagaaaactggtggttctccaattacagggtatcatctcgagttcaaggaaagaaacagccttttgtggaagagagctaacaagactccgataaggatgagagactttaaagtgacaggattaactgaaggtcttgaatatgaattccgagttatggcaatcaatttagcaggtgtgggcaagccaagcctaccatcagagcctgttgtggcactggacccaattgatcctcctggaaaacctgaggttattaacataacaaggaattcagtgactctcatttggactgaacctaaatatgacggtggtcataagttaactggatatatagtggagaagcgagatctaccttcgaagtcttggatgaaagccaaccatgttaatgtcccagaatgtgcctttactgtaactgaccttgttgagggtggaaaatatgaattcagaattagagcaaagaatacagcaggtgctatcagtgctccatcagaaagtacagaaaccattatttgcaaggatgaatacgaggcaccaacaattgtccttgatcccacaataaaagatgggctaacaattaaagcaggggataccattgttttgaatgccattagcattcttggcaaaccccttccaaaatcaagttggtccaaggcaggaaaagacattagaccatcagatatcactcagataacttcaaccccaacatcttccatgcttactatcaagtatgccactagaaaagatgcgggtgaatataccatcactgctaccaatccttttggcacgaaggtggaacatgtgaaggtaacagtccttgatgtacctggtcccccaggtcctgttgaaatcagtaatgtttctgctgaaaaagcaacacttacatggacacctcccttggaagatggcggctcaccaattaagtcctatatacttgaaaagagagaaaccagccgacttttgtggacagtggtttctgaagatattcagtcttgcaggcatgtggcaaccaaacttatccaaggaaatgagtacatcttccgggtctcagctgtaaaccactatggcaaaggagaacctgtacagtctgaacctgtcaaaatggtagacagatttggtccccctggccctcctgaaaaaccagaggtatcaaatgtcactaagaacactgccactgtcagctggaaaaggccagtggatgatggtggcagcgaaattacaggatatcatgtagaaaggagagaaaagaaaagcctgcgatgggtgagagcaataaaaacaccagtttccgatctcaggtgcaaagtaacaggactgcaagaaggaagcacctacgaattccgtgtcagtgcagaaaacagagcaggaattggtccacccagtgaggcttcagattctgttctgatgaaagatgcagcatatcctccaggaccaccttcaaatccgcatgtcactgatactaccaagaaatctgcttctttggcatggggcaagcctcattatgatggtggacttgaaatcactggctatgtcgtggagcatcaaaaagtaggagacgaggcctggataaaagataccacaggaaccgccctcagaatcactcagttcgttgttcctgatcttcagactaaagaaaaatacaacttcagaatcagtgccatcaacgatgcaggtgttggggagccagcggtgattccagatgttgaaatcgtagaacgggagatggctcctgattttgaactagatgccgagcttcgaagaacacttgttgttagagcaggactcagtattaggatatttgtgccaattaaaggtcgtcctgctcctgaagtgacatggaccaaagataacatcaacctgaaaaaccgagccaacattgaaaatacggaatcatttactcttctgattatcccagaatgtaacagatatgataccggtaaatttgtcatgaccattgaaaacccggctgggaagaaaagtggctttgtgaacgtcagagtcttggacacgccaggcccagtcctcaacctgcggcctacagacatcacaaaggacagtgtcaccctgcactgggacctccctctgatagatggaggctcacgtataacaaactacattgtagagaaacgtgaagcaacacggaaatcttattccacagccaccactaagtgccataaatgcacatataaagttaccggcttgtctgaagggtgtgaatatttcttcagagtgatggcagagaatgaatatggaattggtgagccaacagaaactacagagcccgtaaaagcctctgaagcaccatctccaccagacagccttaacatcatggacataactaagagcaccgtcagcctggcatggcctaagcccaaacacgatggtggcagcaagatcactggctatgtgattgaagcccaaagaaaaggctctgaccagtggacccacatcacaaccgtgaaagggttagaatgtgttgtgaggaatctaactgaaggagaggaatataccttccaagtgatggcagtgaacagcgcggggagaagtgcccctagagaaagcagacccgtcattgtcaaggagcagacaatgcttccagagctggatctccgtggcatctatcagaaactggtcattgccaaagctggtgacaacatcaaagttgaaattccagtgctcggtcgaccgaagcccacagtgacatggaaaaaaggagaccaaattcttaaacagacacagagagttaattttgaaaccacagcgacttcaaccattttaaatatcaatgagtgtgtcagaagtgatagtgggccctatccattaacagcaaggaacattgtaggagaggttggtgatgtcatcaccattcaagtccatgatatcccagggccacctactggaccaatcaaatttgatgaagtttcatctgattttgtaaccttctcttgggacccacctgagaacgatggtggtgtaccaataagcaactatgtagtggaaatgcggcagactgacagtactacctgggttgagttagcaaccaccgttatacgtactacctataaagccacccgccttactactggattagagtatcagttccgtgtaaaagctcagaatagatatggagttggaccaggcatcacatcagcatgcatagttgccaactatccatttaaggttcctggacctcctggtacccctcaggtaactgcagttaccaaggattcaatgacaattagctggcatgagccactttctgatggtggaagccccattttaggatatcatgttgaaagaaaagaacgaaatggtattctctggcagactgtgagcaaagctttagtaccaggcaacattttcaaatcaagtggacttacagatggtattgcttatgagttccgggtgattgcagaaaacatggcaggcaaaagtaagccaagcaagccatcagaacctatgttggctctggatcccattgacccacctggaaaaccagtacctctaaatattacaagacacacagtaacacttaaatgggctaagcctgaatatactgggggctttaaaattaccagttatatcgttgaaaagagagaccttcctaatggacggtggctgaaggccaacttcagcaacattttggagaatgaatttacagtcagtggcctaacagaagatgctgcatatgaattccgtgtgatcgccaaaaatgctgcaggtgccatcagtccaccatctgagccatctgatgctatcacttgcagggatgatgttgaggcaccaaagataaaggtggatgttaaatttaaggacacggttatattaaaagcaggtgaagcattcagactggaagctgatgtttcaggccgcccacctccaacaatggaatggagcaaagatggaaaagagctggaaggcacagcaaagttagaaataaaaattgcagatttctctactaatctggtaaacaaagattcaacaagaagggatagtggtgcctatacccttacagcgactaatcctggtggctttgctaaacacattttcaatgtcaaagttcttgacagaccaggcccacctgaaggacctttggctgtaactgaagtgacatcagaaaagtgtgtactatcatggttccctccactggatgatggaggtgccaaaattgatcattacatagtacagaaacgtgaaaccagcagattggcatggacaaatgtagcctcagaagtccaagtaacaaagctaaaggtcactaaactcttgaaaggcaatgaatacatattccgtgtcatggctgtaaataaatatggagtgggagagccactggaatcagagcctgtgcttgcagtgaatccttatggaccccctgatccgcccaaaaaccctgaagtgacaactattactaaagattcgatggttgtctgctggggacatcctgattctgatggtggaagtgaaatcatcaattatattgtggaacggcgtgataaagctggccaacgctggattaaatgcaacaaaaaaactcttactgatttaagatataaagtgtctggactgacagaaggacatgaatatgagttcaggattatggctgaaaatgctgctggaattagtgcaccaagtcctaccagtccattttacaaggcttgtgacactgtgtttaaacctggaccaccaggtaacccacgtgttctggatacaagcagatcatccatttcaatcgcttggaataaacctatctatgatggtggttcagaaatcactgggtatatggttgagattgccctgccagaggaagatgaatggcagattgtcactccaccagcaggactcaaggcaacttcgtatactatcactggcctcacagagaatcaggaatataagatccgcatctatgccatgaattccgaaggacttggggaacctgcccttgttcctggaactccaaaggctgaagacagaatgctgcctccagaaattgaactggatgctgacctgcgcaaagttgttactataagggcctgctgcaccctgagactttttgttcccatcaaaggaaggcctgcacctgaggtgaagtgggcccgggaccatggagaatctttagataaagctagcatcgaatccacaagctcttacaccctgcttattgttggaaatgtaaacagatttgacagtggcaaatatatactaactgtagaaaatagttcaggcagcaagtctgcatttgtcaatgttagagttctcgatacaccaggccccccacaggatctgaaggtaaaagaggtcactaagacatctgtcacactcacatgggacccacctctccttgatggaggttcaaaaatcaagaactatattgttgaaaagcgggaatcaacaagaaaagcatattcaactgttgcaacaaactgccacaagacttcctggaaggtagaccagcttcaagaaggctgtagctactatttcagggttctcgcagaaaatgaatatggcattgggctgcctgctgaaaccgcagaatctgtgaaagcatcagaacgacctcttcctccaggaaaaataactttgatggatgtcacaagaaatagtgtgtcactctcttgggagaaaccagagcatgatggaggcagccgaattctaggctacattgtggagatgcagaccaaaggcagtgacaaatgggccacgtgtgccacagtcaaggtcactgaagccactatcactggattaattcagggtgaagaatactctttccgtgtttcagctcagaatgaaaagggcatcagtgatcctagacaactgagtgtgccagtgatcgccaaagatcttgtcattccaccagccttcaaactcctgttcaatactttcactgtactggcaggtgaagacctaaaagttgatgttccattcattggccgccctaccccagctgtaacctggcataaagataatgtaccactgaagcagacaactagagtaaatgcagagagcacagaaaataattcactactgacaataaaggacgcctgccgagaagatgttggccattatgtggttaaactgactaactcagctggtgaagctattgaaacccttaatgttatcgttcttgacaaaccagggcctccaactggaccagttaaaatggatgaagtgacagctgatagtattactctttcctggggcccacccaagtatgatggtggaagttctatcaataattacattgttgagaaacgggacacttccacaaccacctggcaaattgtatcagctacagttgcaaggacaacaataaaggcttgcagactgaagactggatgtgaatatcagtttagaattgcagctgaaaacagatatgggaagagtacctacctcaattcagagcctactgtagcccaatatccattcaaagttcctggtcctcctggcactccagttgtcacactgtcctccagggacagcatggaagtacaatggaatgagccaatcagtgatggaggaagtagagtcattggctatcatctagaacgcaaggaaagaaatagcatcctctgggttaagttgaataaaacacctattcctcaaaccaagtttaagacaactggccttgaagaaggtgttgaatatgaatttagagtctctgcagagaacatcgtgggcattggcaagccgagtaaagtatcagaatgttatgtggctcgtgacccatgtgatccaccaggacggccagaggcaatcattgtcacaaggaattctgtgactcttcagtggaagaaacccacctatgacggtggaagcaagatcactggttatattgttgagaagaaagaattacctgagggccgttggatgaaagccagttttacaaatattattgacactcattttgaagtaactggcctagttgaagatcacagatatgagttccgggttatagcccgaaatgccgcaggagtgtttagtgagccttcagaaagcacaggagcaataacagctagagatgaggtagatccaccacgaataagtatggatccaaaatacaaagacacaatcgtggttcatgctggtgaatcattcaaggttgatgcagatatttatggcaaaccaataccaaccattcagtggataaaaggtgatcaggagctttcaaacacagctcgattagaaataaagagcaccgactttgccaccagtctcagtgtaaaagatgcagtacgtgtcgacagtggaaattacatactgaaggccaaaaatgttgcaggagaaagatcagttactgtgaatgtcaaggttcttgacagaccagggccacctgaaggacctgttgttatctcaggagttacagcagaaaaatgcacactagcttggaaacccccacttcaggatggtgggagtgacatcataaattatattgtggaaaggagagaaaccagccgcttagtttggactgtggttgatgccaatgtgcagactctcagctgcaaggttactaagcttcttgaaggcaatgaatatactttccgtataatggcagtaaacaaatatggtgttggtgaacctcttgaatctgagccagtagttgccaagaatccatttgtagtaccagatgcaccaaaagctccagaagtcacaacagtgaccaaggactcaatgattgttgtatgggaaagaccagcatctgatggtggtagtgaaattcttggatatgttcttgagaaacgggataaagaaggcattagatggacaagatgccataagcgtctgattggagagttgcgcctgagagtaactggactcatagaaaatcacgattatgagttcagagtttctgctgagaatgctgctggacttagtgaaccaagccctccttctgcttaccaaaaggcttgtgatcctatttataaaccaggacccccaaacaaccccaaagtcatagacataaccagatcttcagtattcctttcttggagcaaaccaatatatgatggtggctgtgaaattcaaggatacattgttgaaaaatgtgatgtgagtgttggtgaatggacaatgtgcactccaccaacaggaattaataaaacaaacatagaagtagagaagctgttggaaaagcatgaatacaacttccgtatctgtgctattaataaagctggagttggagaacatgctgacgtccctggacctattatagttgaagaaaaattagaagcaccagacattgatcttgacctagaactaaggaaaatcataaatataagggcaggtggctccttaaggttatttgttcctataaaaggtcgtcctacaccagaagttaaatggggaaaggtggatggtgaaatccgagatgcagctataattgatgtcactagcagtttcacctctcttgttcttgacaatgtcaaccgatatgatagtggaaaatatacgcttacattagaaaacagcagtggaacaaagtctgcctttgttactgtgagagttctggacacgccaagtccacctgttaacctgaaagtcacagaaatcaccaaagactcagtatcaattacatgggaacctcctttgttggatgggggatccaaaataaaaaattacattgttgagaaacgtgaagccacaagaaaatcatatgctgctgttgtaactaactgccataagaattcttggaaaatcgatcagctccaagaaggttgcagttattactttagagtcacagctgagaatgagtatggtattggccttcctgcccagactgctgatccaattaaggttgcagaagtgccacaacctcctggaaaaataactgtggatgatgtcaccagaaacagtgtctctctgagttggacaaaacctgaacatgatggtggcagtaaaatcattcagtatattgtggaaatgcaagctaaacacagtgagaaatggtcagagtgtgctcgagtaaagtctcttcaggcagtaattaccaacctaactcaaggggaagaatatctttttagagttgttgctgtaaatgaaaaggggagaagtgatcctcggtcccttgcagttccaatagttgccaaagatctggtaattgagccagatgtaaaacctgcattcagtagttacagtgtacaggttggccaagatttgaaaatagaagtgccaatttctggacgtcctaagccaaccattacctggactaaagatggtctcccactgaagcagaccacaagaatcaatgttaccgattcactggatctcaccacactcagtattaaagaaactcataaggatgatggtggacaatatggaatcacagttgccaatgttgttggtcagaagacagcatccatcgaaattgtaactctagataaacctgatcctccaaaaggacctgttaaatttgatgacgtcagtgctgaaagtattacattatcttggaaccctccattatatacagggggctgccaaatcaccaactacattgttcagaaaagagatacaaccaccacagtatgggatgttgtttctgctactgttgctagaactacactcaaagtgaccaaactgaaaactggtacagaataccaatttagaatatttgccgaaaacagatatggacaaagctttgccttagagtctgatccaattgtagctcaatatccctacaaagaaccaggccctccaggtacaccatttgccacagccatttccaaagactccatggtcatacagtggcatgaaccagtcaacaatggtggaagccccgtcataggttaccacctggagagaaaagaaagaaacagtattttgtggacaaaggtcaacaaaactattattcatgacacccaattcaaagcacagaatcttgaagaaggcattgaatatgaattcagagtgtatgctgaaaatattgttggtgtaggcaaagcaagcaagaattctgaatgctatgtagccagagatccctgtgacccaccaggaaccccagaaccaataatggttaaaagaaatgaaatcactttacagtggaccaaacctgtgtatgatggtggaagtatgattacaggctacattgtagagaaacgtgatttgcctgatggtcgttggatgaaagctagctttacaaatgtcattgaaactcaatttactgtgtcaggtcttactgaagatcaaagatatgaattcagagtcattgcaaagaatgcagctggtgcaataagtaaaccctctgacagtactggaccaataactgccaaggatgaggttgaactcccaagaatttcaatggatccaaaattcagagacacaattgtggtaaatgctggagaaacattcagacttgaggctgatgtccatggaaagcccctacctaccattgagtggttaagaggagataaggaaattgaagaatctgctagatgtgaaataaagaacacagatttcaaggctttacttattgtaaaagatgcaattagaattgatggtgggcagtatattttaagagcttccaatgttgcaggttctaagtcattcccagtaaatgtaaaagtattagatagaccaggacctccagaagggccagtccaggttactggagtcacttctgaaaaatgctctttaacatggtctccaccacttcaagatggtggcagtgacatttctcactatgttgttgaaaagcgagaaaccagtcgacttgcctggactgttgttgcttcagaagttgtgaccaattctctgaaagttaccaaactcttagaaggtaatgaatatgttttccgtataatggctgtcaacaaatatggtgttggagagcctttggaatctgcaccagtactaatgaaaaatccatttgtgcttcctggaccaccaaaaagcttggaagtcacaaatattgccaaagactccatgaccgtctgttggaaccgtccagatagtgatggtggaagtgagattattggttacattgtagagaaaagagacagaagtggcattcgatggataaaatgtaataaacgccgcattacagatttgcgtctaagagtgacaggattaacagaagatcatgagtatgaattcagggtctctgcagaaaatgctgctggagttggggaaccaagtccagctacagtttattataaagcctgtgatcctgtgttcaaacctggcccacctaccaatgcacacattgtagacaccactaaaaattcaatcacacttgcctggggtaaacccatctatgatggcggcagtgagatcttgggatatgtagtagaaatctgtaaagcagatgaagaagaatggcaaatagttactccacagactggcctgagagtcactcgatttgaaatttcaaaactcactgaacaccaagagtataaaatacgagtctgtgccctcaacaaagttggtttaggtgaggctacatcagttcctggtactgtgaaaccagaagataaacttgaagcacctgaacttgaccttgactccgaattaagaaaaggaattgttgtaagagctggtggatctgccagaattcacattccattcaaaggtcgtccaacgcctgagatcacttggtctcgagaggaaggtgaattcacagataaggtccaaattgaaaagggagtaaactatacccaactatcaatagataactgtgatagaaatgatgctggaaaatacattcttaagttggaaaacagcagtggatcaaagtctgcttttgtaactgtgaaagttcttgacactccaggaccaccacagaatttggcagtcaaagaagtgagaaaagattctgccttcctggtatgggagccacccatcattgatggaggggcaaaggtcaagaactatgtgattgacaaacgtgagtcaaccagaaaagcgtatgctaatgtgagtagtaaatgcagcaaaacaagttttaaagtggaaaaccttacagaaggagccatttattacttcagagtcatggctgaaaatgaatttggagttggtgttccagtggaaactgttgatgccgtgaaagctgctgaacctccttccccaccaggaaaggttacactcactgatgtgtcccagaccagtgcatcacttatgtgggagaaacctgaacatgatggcggtagcagagtcctggggtacgttgttgaaatgcagcccaaaggaactgaaaaatggagcattgtggctgaatccaaagtctgtaatgcagttgttactggtttgagttctggacaagaatatcagttccgtgtcaaggcttataatgagaaaggaaaaagcgatccaagagtgttgggtgttcctgtcatagccaaggacttgactatacagcctagtttaaagttaccatttaacacatatagtatccaagctggagaagatcttaaaatagaaattccagttataggccgaccaagacctaacatttcttgggtcaaagatggtgagcctcttaaacagacaacaagagtaaacgttgaagaaacagctacctcaactgttttgcacattaaagaaggtaacaaagatgactttggaaaatacaccgtaacggcaacaaatagtgcaggcacagcaacagaaaatctcagtgttatcgttttagaaaagcctggacctccagttggcccagttcggtttgatgaagttagtgcagactttgtagtcatatcttgggaacctccagcctatactggtggctgccaaataagcaactacattgtagagaagcgagatacaaccaccaccacttggcacatggtatcagcaacagttgcaagaacaacaattaaaataaccaaactgaaaacaggcacggagtaccagtttagaatttttgctgaaaacaggtatggaaaaagtgccccactggattctaaggcagttattgtacaatatccatttaaagaacctggaccacctggaactccttttgtgacatcaatctcaaaagatcagatgcttgtgcaatggcatgagccagtgaatgatggaggcaccaaaattattggctaccatcttgaacagaaagaaaagaacagtattttatgggtcaagttaaataagacccccattcaggacaccaaattcaaaacaactgggcttgatgagggccttgagtatgagttcaaagtttctgctgaaaatattgttggcattggcaagcctagcaaagtgtcagaatgctttgttgctcgtgatccatgtgacccacctggtcgccctgaagccattgttattacaagaaacaatgtcacactgaaatggaagaaacctgcctatgatggtggtagcaaaataacaggttatattgtagaaaagaaagatctacctgatggccgctggatgaaagccagctttaccaacgtattagaaactgaatttacagtgagtggacttgtagaagaccaaagatatgaatttagagtaattgcaagaaatgcagctggaaactttagtgaaccatctgatagtagtggtgccattactgcaagagatgaaattgatgcaccaaatgcctctctggatccaaaatataaagatgtcatcgttgttcatgcaggagagacttttgttcttgaagccgacatccgtggcaaacctatacctgatgttgtttggtcaaaagatggaaaagaacttgaagaaacagctgctagaatggaaattaaatctactattcagaaaacaactcttgttgtcaaagactgtatacggactgatggaggacaatatattctgaaactcagcaatgttggtggtacaaagtctatacccatcactgtaaaggtacttgacaggccagggcctcctgaagggcctctgaaagttactggagttactgcggaaaaatgttacctggcatggaacccacctttgcaagatggtggtgctaatatttcacattacatcattgaaaagagggagacaagccgactctcttggacccaggtttcaactgaggtacaggcccttaactacaaagttactaaacttcttcctggtaatgagtacattttccgtgtcatggctgtgaataaatatggaattggagagcccttggaatctgggcctgttacggcctgtaatccttataagccaccaggtcctccctcaacacctgaagtctcagcaatcaccaaagattctatggtagtaacatgggcacgcccagtagacgacggaggtaccgaaattgagggctacattcttgaaaaacgagataaggaaggcgttagatggaccaagtgcaacaagaaaacattaacggatctgcggctcagggtaactggtcttaccgaaggccattcctatgaattcagagttgctgctgaaaatgcagctggtgtgggagaacctagtgagccatctgttttctaccgtgcgtgtgatgccttgtatccaccaggtcccccaagcaatccaaaagtgacggacacttccagatcttctgtctccctggcatggagtaagccaatttatgatggtggcgcacctgttaaaggctatgttgtagaggtcaaagaagctgctgcggatgaatggacaacctgcactccaccaacaggattacaaggaaagcagttcacagtgaccaagcttaaagaaaacactgaatataacttccgtatttgtgccatcaattctgaaggtgtaggtgaacctgcaactctacctggctcagtggttgctcaggagaggatagagccaccagaaatagaactcgatgctgatctcagaaaggtggtcgttctgcgtgcaagtgctactttacgcttatttgtcactatcaaaggtcgaccagaacccgaagttaaatgggaaaaggcagaaggcattctcactgacagggctcagatagaggtgaccagctcatttacaatgttggtgattgataatgttaccagatttgacagtggtcggtataatctgacattagaaaataatagtggctccaaaacagcttttgttaacgtcagagttcttgactcaccaagtgcccctgtgaatttgaccataagagaagtgaagaaagactcagtgacgttgtcctgggaaccaccacttattgatggtggagctaagattacaaactacattgtcgaaaaacgagaaactacaagaaaagcctatgctaccattacaaataattgcactaaaactactttcagaattgaaaatctacaagaaggatgttcttactacttccgagtcttggcttccaatgaatatgggattggtttgccagctgaaacaacagaacccgttaaagtgtctgaaccacccctcccacctggaagagtaactcttgttgatgtgacccgtaatacagctacaattaagtgggagaaaccagaaagtgatggtggcagcaaaattactggttatgtggttgaaatgcagactaaagggagtgaaaagtggagcacctgcacacaagttaagactctagaagcaactatatctggcttaactgcaggagaagagtatgtcttcagggtagctgcagttaacgaaaagggaagaagtgatccaagacaacttggagtgccagtaattgcaagggatattgaaataaagccttcagttgagcttcctttccatactttcaatgtaaaggctagagaacaacttaagattgatgtgccattcaaaggaagacctcaagctactgtgaactggagaaaagatggtcagactcttaaagagacaactagagtcaatgtttcttcttcaaagactgtaacatcactatctattaaggaagcttcaaaggaagatgttggaacttatgaattatgtgtttcaaacagtgctggatccataacagttcctattactataattgtccttgacagaccaggacctccaggtcctatacgtattgatgaggttagttgtgacagcataaccatttcttggaatcctccagaatatgatggtggctgccaaattagcaattacattgttgaaaagaaagaaaccacctctacaacatggcacatagtttcacaagcagttgcaagaacatccattaaaatagttcgcctgacaacaggaagtgagtatcagttccgtgtttgtgcagaaaaccgctatggaaagagctcctacagtgaatcttcagctgttgttgcagagtatccattcagtcccccaggtcctcctggtactcctaaagttgtgcatgccacaaaatctaccatgcttgtaacctggcaagtgccagttaatgatggaggaagtcgagtaattggctatcatcttgagtataaagaaagaagcagcattctttggtcaaaagcaaataaaatcctcattgctgatactcaaatgaaagtctccggccttgatgaaggactgatgtatgagtatcgtgtatatgctgaaaatattgctggaattggtaaatgcagtaaatcttgtgaaccagtccctgcaagagatccttgtgaccctcctggacaacctgaagtcacaaatatcacaagaaaatcagtgtcacttaaatggtctaaaccacattatgatggtggagctaagatcacaggatacattgttgaacgcagagaactaccagatggccggtggctgaagtgcaattatactaatatacaagaaacatactttgaagtaactgaacttactgaagatcagcgttatgaattccgggtttttgcaaggaatgctgctgactcagttagtgagccatctgaatccactgggcctattatagttaaagatgatgttgagcctccaagagttatgatggatgtcaagttccgagacgttattgttgtcaaagctggagaggtccttaagataaatgcagacattgcagggcgacctctgccagtaatttcctgggccaaggatggtatagaaattgaagaaagagcaagaacagaaatcatctcaacagacaatcatactttgttaacagttaaagactgtataagacgagacactgggcaatatgtactaacactgaagaatgttgccggcactcggtctgtggccgttaattgcaaagtacttgataagcctggtccaccagcaggaccacttgaaataaatggcctcactgctgagaaatgctctctttcctggggacgtccccaagaagatggtggtgcagatatcgactattacatcgtagaaaaacgtgaaacaagccaccttgcatggacaatatgtgaaggagagttacagatgacatcctgtaaagtaaccaagttactcaaaggcaatgaatatatatttagagtaactggtgttaataaatatggtgttggtgagcccctagagagtgtagctataaaggcactagatccatttacagttccaagtccacccacgtctttggaaattacttctgtgaccaaagaatctatgacactttgctggtcaagacccgagagtgatggaggtagtgaaatatctggatatataattgaaaggcgagagaaaaatagcctaagatgggtgcgtgtaaacaaaaaaccagtttatgatctaagagtgaaatcaacaggacttcgggaaggatgtgaatatgaatatcgtgtttatgcagaaaatgctgctggcctaagtcttccaagtgaaacctctcccttaattagggcagaagatccagtgttcctaccatctcctccatccaaacccaaaattgtggactcaggcaagacaactataactattgcctgggttaagccgctgtttgatggtggggccccgataactggatatactgtagaatacaaaaaatctgatgacactgactggaaaacttccattcagagcttacgagggacagaatatacaataagcggactaacaacaggagctgaatatgttttcagagtaaaatctgtcaataaggttggtgctagtgaccccagtgatagctctgaccctcagatagcaaaggaaagagaagaagaacctttatttgatattgacagtgaaatgaggaagaccttgattgtcaaggctggtgcctcatttaccatgactgtgcctttccgaggaagaccagtacccaatgtcttgtggagtaagccagacactgacctccgtactagagcttatgttgataccacagactcccgtacatcactgaccattgaaaatgccaacagaaatgactctggaaagtacacattaacaattcagaatgttttgagtgctgcttcactgaccttagttgtcaaagttttagataccccaggtcctccaaccaacattactgtgcaagatgtaaccaaagagtctgcagtgttatcctgggatgttcctgaaaacgatggtggagcaccagtgaagaattaccacatagaaaaacgtgaggccagcaagaaagcatgggtctctgtgaccaacaactgtaaccgcctctcctacaaagttaccaatttacaagaaggagctatctattacttcagagtctctggagaaaatgagtttggtgttggtataccagctgaaacaaaggaaggagtaaaaataacagaaaaaccaagcccacctgaaaaacttggagtaacaagtatatccaaagacagtgtttccctgacctggctgaagcctgaacatgatggcggaagcagaattgtacactatgtcgttgaagcactagaaaaaggacagaaaaactgggttaaatgtgcagtggcaaagtcaacccatcacgttgtttccggtctgagagagaattctgaatactttttccgagtgtttgctgaaaatcaagctggcctgagtgacccgagagagcttctgcttcctgttcttattaaggagcaactagaaccacctgaaattgatatgaagaatttcccaagtcacactgtatatgttagagctggttcaaaccttaaagttgacattccaatctctggaaaaccacttcccaaagtgaccttatcaagagatggtgtcccccttaaggcaaccatgagatttaataccgaaattactgctgagaacctgaccatcaatctcaaagaaagtgttacagctgacgctgggagatatgaaatcactgctgccaactccagtggtacaaccaaagctttcattaacattgttgtgctagacaggcctggtcctccaactggccctgttgttattagtgatataactgaagaaagtgtgactctcaaatgggagccacctaagtatgacggtggaagtcaagttaccaactacattctactcaaaagagaaacaagtactgcagtgtggactgaagtgtctgcaacagttgcaagaaccatgatgaaagtcatgaaactgaccacaggagaagaataccaattccgcatcaaggcagaaaaccgctttggcatcagtgatcatatagattcagcttgtgtgactgtcaaactaccatacacaacacctggaccaccatctacaccatgggtcactaatgttactcgagaaagcatcactgtgggctggcatgaaccagtgtcaaatggaggcagtgcagtcgtaggctatcacctggaaatgaaagacagaaacagtattttatggcaaaaagccaacaaactggtcatccgcacaactcacttcaaagtcacaacaatcagtgctggacttatttatgaattcagggtgtatgcagaaaatgctgctggagttggaaaacctagccatccttctgaaccagtcttggcaattgatgcttgtgaacccccaagaaatgttcgtatcactgatatttcaaagaactctgtcagcctttcatggcaacaaccagctttcgatggaggtagcaagattacaggctacattgttgagagacgtgaccttccagatggcagatggaccaaggccagcttcaccaatgttactgaaactcaattcatcatctctggcttgactcagaattcccagtatgaattccgtgtctttgctaggaatgctgttggttccattagcaatccatctgaggttgtagggcccattacttgcatcgattcttatggtggtcctgtaattgatttgcctctagaatatacagaagttgtcaaatacagagcaggtacatctgtgaagctcagagctggcatttctggcaaacctgcgcctactattgagtggtataaagatgataaagaattacaaaccaatgcactggtgtgtgttgaaaataccacggacctcgcatctatactcatcaaagatgccgatcgccttaatagtggatgctatgaattaaaactaaggaatgccatgggctcagcctcagccaccatcagagtacagatccttgacaaaccaggcccacctggtggaccaattgaatttaagactgtaactgctgagaagatcacccttctctggcggcctccagctgatgatggtggtgcaaaaatcactcactacattgtggaaaagcgtgagacaagccgcgttgtgtggtctatggtgtctgaacatttggaagagtgcatcattacaaccaccaaaattatcaaaggaaatgaatacatcttccgggtccgagccgtgaacaaatatggaattggcgagccactggaatctgattccgttgtagccaagaacgcatttgttacacctgggccaccaggcataccagaagtgacaaagattaccaagaattcgatgactgttgtatggagcaggccaattgcagatggcggtagtgatataagtggctatttccttgaaaaacgagacaagaagagcctaggatggtttaaagtactaaaagagactatccgtgacaccagacaaaaagtaacaggactcacagaaaacagtgactatcaatacagagtttgtgctgtaaacgctgctggacagggtccattttctgaaccatctgaattctacaaagctgctgatcctattgatcctccaggtccacctgctaagataagaatcgcagattcaaccaagtcatccatcacccttggctggagtaagcctgtctatgatgggggcagtgctgttactgggtatgttgtcgagataagacaaggagaggaagaggaatggactactgtctctaccaaaggagaggtcagaactacagaatatgtggtatccaacctgaaacctggagtcaattactacttccgggtatctgctgtaaactgtgctggacaaggagaacctatagaaatgaatgaacctgtacaagctaaagatatacttgaggcaccagagattgacctggatgtggctctcagaacttctgttattgccaaagctggtgaagatgtacaagtgttgattccctttaaaggcagacctccacctactgtcacatggagaaaagatgagaagaatcttggcagtgatgccagatacagcattgaaaacactgattcatcctcattactcaccattcctcaagttactcgcaatgatacaggaaaatatattctcacaatagaaaatggagttggtgaacctaagtcttcaactgtgagtgttaaagtgcttgacacaccagctgcctgccagaaactacaggttaaacatgtttctcgaggcacagtcactttgctctgggatcctcctctcattgatggaggatctccaataattaattatgtcattgaaaagagagatgccaccaagagaacatggtctgtcgtgtcacacaaatgttctagcacatccttcaagctaatagatttgtcggagaagactccattcttcttcagagttcttgcagaaaatgaaattggaattggggaaccctgtgaaactacagagccagtgaaggctgctgaagtaccagctcctatacgtgatctctcaatgaaagactcaacaaagacatctgtcatcctcagctggaccaaacctgactttgatggtggtagcgtcatcacagaatatgttgtagaaaggaaaggtaaaggtgaacagacgtggtcccacgctggcataagtaagacatgtgaaattgaggttagccaacttaaggagcagtcagtcctggagttcagagtgtttgccaaaaatgagaaaggactgagtgatcctgtcactattgggccaattacagtgaaagaacttattattacacctgaagttgacctgtcagatatccctggggcacaagtcactgtgagaattgggcacaatgtgcaccttgaattaccttataagggaaaacccaaaccatccatcagttggctgaaagatggcttgccactgaaagaaagtgaatttgttcgcttcagtaaaactgaaaacaaaattactttgagtattaagaatgccaagaaggagcatggaggaaaatacactgttattcttgataatgcagtgtgtagaattgcagtccccattacagtcatcacccttggcccaccatcaaagcccaaaggacccattcgatttgatgaaatcaaggctgatagtgtcatcctgtcatgggatgtacctgaagataatggaggaggagaaattacttgttacagcatcgagaagcgggaaacttcacaaactaactggaggatggtgtgttcaagtgttgccagaacgactttcaaagttcctaatctagtcaaagatgctgagtaccagtttagagtgagagcagaaaacagatacggagtcagccaaccacttgtctcaagcattattgtggcaaaacaccagttcaggattcctggtcccccaggaaagccagttatatacaatgtgacttctgatggcatgtcactaacttgggatgctccagtttatgatggtggttcagaagttactggattccatgttgaaaagaaagaaagaaatagcatcctctggcaaaaagttaatacatcaccaatctctggaagagaatatagagccactggactggtagaaggtctggattaccaattccgtgtatatgctgaaaattctgctggcctaagctcacctagtgacccaagcaaatttaccttagctgtttctccagtagacccacctggcactcctgactacattgatgtcacccgggaaaccatcacacttaaatggaacccaccattgcgtgatggaggcagtaagattgtgggctatagcattgagaaacggcaaggaaatgaacgctgggtgagatgcaactttactgacgtcagtgaatgtcagtacacagttacaggactcagtcctggggatcgctatgagttcagaataattgcaagaaatgctgttggaactataagcccgccctcacagtcttctggcattattatgacaagagatgaaaatgttccaccaatagtagagtttggccctgaatactttgatggtctcattattaagtccggagagagccttagaattaaagctttggtacaaggaagaccagtgcctcgagtaacttggttcaaagatggagtggaaatcgaaaagaggatgaatatggaaataaccgacgtacttggatccaccagcctatttgttagagatgctactcgggaccatcgtggtgtatacacagtggaagccaaaaatgcatctggttctgcaaaagcagaaattaaagtgaaagtacaagatacaccaggaaaagtagttgggccaataagattcaccaatattactggggagaagatgactctgtggtgggatgccccactcaatgacggttgtgctcccataacccactacatcattgaaaaacgggaaaccagcagacttgcctgggcactaattgaggataaatgtgaagcccaaagttacactgccattaaactaataaacggcaatgaataccaattccgtgtttctgcagttaacaagtttggtgttggcaggccacttgattctgatccagtggttgctcaaatacaatatactgttcctgatgcccctggcattccagaacctagcaacataacaggcaacagcattaccctgacatgggcaaggccagaatcagatggtggcagtgaaattcaacagtatatccttgaaagaagagaaaagaaaagcacaagatgggtaaaagtgatcagcaaacgaccaatctctgaaacaagattcaaagtcactggtctgacagaaggcaatgagtatgaattccatgtcatggctgaaaatgctgcaggagttggacctgcaagtggcatctcaagactcattaaatgtagagagcccgtcaacccaccaggtcctcccacagtggtcaaagtaacagacacatcaaagacaactgtgagcttagaatggtccaaaccagtgtttgatggtggcatggaaataattgggtatattattgaaatgtgtaaggccgacttaggagactggcacaaggtgaatgcagaggcatgtgtgaaaacaagatatacagtcactgatctacaagcaggtgaagaatacaaattccgagttagtgctatcaatggtgctggaaaaggcgacagctgtgaagtgactggcacaattaaagcagttgaccggttaacagctcctgagttagacatagatgcaaacttcaaacagactcatgttgttagagctggggccagtattcgcctcttcattgcctaccaaggtagacctactcctacagctgtgtggagcaaaccagactctaaccttagccttcgggctgatatccatacaacagattccttcagcaccctcactgtggaaaactgcaacagaaatgatgcagggaaatatacccttactgtggaaaacaacagtggtagtaagtcaatcacattcaccgtgaaagtgctagacactccaggcccacctggcccaattaccttcaaagatgtgacccggggatctgctacattgatgtgggatgcccctcttcttgacggtggtgcccgaatccatcattatgtggtagagaaacgagaggcaagtcgccgtagttggcaggttatcagtgaaaaatgcactcgtcagatcttcaaggtcaatgacctggccgaaggtgttccgtactatttccgtgtttctgcagtaaatgagtatggtgttggtgagccctatgaaatgccagaaccaattgtagccacagaacagcctgctccacctaggagacttgatgttgttgatactagcaaatcctccgcagtcttagcttggcttaaacctgaccacgatggaggcagccggatcactggctacctgcttgaaatgagacaaaagggatctgacttctgggttgaagctggtcacaccaaacagctaactttcacagtagagcgtcttgttgagaaaactgaatatgaattccgtgtgaaggccaagaatgatgctggctatagtgaacccagagaagccttctcttctgtcatcattaaggagcctcaaatcgagcccactgctgacctcactggaattaccaatcagcttataacttgcaaagcaggaagcccatttaccattgacgtaccaatcagtggtcgtcctgcccccaaagtaacatggaaactggaagaaatgagacttaaagagacagatcgagtgagcattacaacaacaaaagacagaaccacactgactgtaaaggacagcatgagaggtgactctggaagatacttcttgaccctggaaaatacagctggtgttaaaacatttagcgtcacagttgtggtcattggaaggccaggtccagtaaccggccccattgaggtctcatctgtctcagctgaatcgtgtgtcctgtcatggggagaacctaaagatggaggaggcactgaaattactaattacatagttgaaaagcgtgaatcgggtacaacagcttggcagcttgtcaattccagtgtcaagcgcactcaaattaaagtcactcatctcacaaaatacatggaatattctttccgtgtcagttcagagaacagatttggtgtcagcaaacctctagaatcagcaccaataattgctgaacatccatttgtcccaccaagcgctcctaccagacctgaggtctaccatgtgtctgccaatgccatgtctattcgttgggaagaaccctaccacgatggtggcagtaaaatcattggctactgggttgagaagaaagaacgtaatacaattctttgggtgaaagaaaacaaagtgccatgcttagagtgcaactacaaagtaactggtttagtagaaggactggaatatcagttcagaacttatgcactcaatgctgcaggtgttagcaaggccagcgaagcttcaagacctataatggctcaaaatccagttgatgcaccaggcagaccagaggtgacagatgtcacaagatcaacagtatcactgatttggtctgccccagcgtatgatggaggcagcaaggttgtgggctacatcatagagcgtaagccagtcagtgaggtaggagatggtcgctggctgaagtgcaactacaccattgtatctgacaatttcttcaccgtgactgctctcagtgaaggagacacttatgagttccgtgtgttagccaagaatgcagcaggcgtaattagcaaagggtctgaatctacaggccctgtcacttgccgagatgaatacgctccacccaaagccgaactggatgcccgattacacggtgatctggttaccatcagagcaggttctgatcttgttctggatgctgcagttggtggcaaacctgaacccaaaattatctggaccaaaggagacaaggagctagatctctgtgaaaaagtctctttgcagtatactggcaaacgagcaactgctgtgatcaagttctgtgacagaagtgacagtggaaaatacactttaacagtgaaaaatgccagcgggaccaaggccgtgtctgtcatggtcaaagtgcttgattcccctggcccatgtggaaagctcaccgtcagcagagtaacacaggagaagtgcactttagcctggagccttccgcaggaagacggaggagcagaaatcactcactacatcgtggaaagacgcgagactagcaggctcaactgggtgattgttgaaggcgaatgcccaaccctatcctatgtcgttaccaggctcatcaagaacaatgagtacatattccgagtgagggcagtaaacaaatatggccctggtgtgcctgttgaatcagagccaattgtagccagaaactcattcactattccatcaccacccggcatacctgaagaagttgggactggcaaagagcatatcatcattcagtggacaaaacctgaatctgatggtggcaatgaaatcagcaactacctagtagacaaacgtgagaagaagagcctgcgctggacacgtgtcaacaaagactatgtggtgtatgataccaggctgaaggtgaccagcctgatggagggttgtgattaccagttccgggtgaccgcagtgaatgcagctggtaacagtgagcccagcgaagcttccaacttcatctcatgcagagaaccatcatatacccctggaccaccttctgctccaagagttgtggataccaccaaacacagcattagtttggcatggaccaaacccatgtacgatggtggtactgacattgtaggatatgttctggaaatgcaagagaaggacactgatcagtggtaccgagtgcataccaatgccacaataagaaatactgaattcactgtgccagaccttaaaatgggccagaaatattccttcagagttgctgccgtgaacgtgaagggtatgagcgaatacagcgaatcaattgctgaaattgagcccgtggaaagaatagaaataccagatcttgagcttgcagatgatctaaagaagactgtgaccatcagggctggggcctccttgcgcttgatggtgtctgtatctggaagaccacctcctgtcataacgtggagcaagcagggcattgaccttgcaagccgggcaattattgacaccactgagagctactcattgctaatagtggacaaagttaatcggtacgatgctggaaaatacacaattgaagctgaaaaccaatctggcaagaaatcagcaacagtccttgttaaagtctatgatactcctggtccctgtccttcagtgaaagttaaggaagtatcaagagattctgtgactataacttgggaaattcccacgattgatggtggagctccagtcaacaattacatcgttgagaagcgtgaagctgctatgagagcattcaaaacagtaactaccaaatgcagcaagacactttacagaatttctggacttgtagaaggaaccatgtactatttcagagtgctgccagaaaatatttatggcattggagaaccttgtgaaacatctgatgcagtactggtctcagaagtgcctttggtgcctgcaaagctagaagtggtcgatgtcaccaaatccactgttacccttgcctgggaaaaaccactctacgatggtggtagccgactcactggatatgttctcgaggcctgcaaagctggcacagagagatggatgaaggttgtcaccttaaaacccacagtcctagagcacactgttacttccttaaatgaaggtgaacaatacttatttagaataagggcacaaaatgagaaaggtgtgtcagaaccaagagagactgtcacagccgtgactgtacaagacctcagagtgttgccaacaatcgatctttctacaatgcctcagaagaccatccatgtcccagctggcagaccagtagagctggtgatacctattgctggccgtccacctcctgctgcttcctggttctttgctggttctaaactgagagaatcagagcgtgtcacagttgaaactcacactaaagtagctaaattaaccatccgtgaaaccactatcagagatactggagaatacacacttgaattgaagaatgttaccggaactacttcagaaaccattaaagttatcattcttgacaagcctggtccaccaacaggacctattaagattgatgaaattgatgctacatcaattaccatttcctgggaaccacctgaattggacggtggtgctccactgagtggttatgtggtagaacaacgtgacgctcatcgtccaggatggctgcccgtttctgaatcagtgactaggtccacgtttaagtttaccagactcaccgaaggaaatgagtatgtgttccgtgtggctgcaacaaaccgcttcgggattggctcttacttgcagtctgaggtcatagagtgtcgcagcagcatccgtattcctggacccccagaaacattacagatatttgatgtttcccgtgatggcatgacacttacttggtacccaccagaggatgacggtggctcccaagtgactggatatattgtggagcgcaaagaagtgagagcagatcgatgggtccgtgtaaataaagtacctgtgacaatgacacggtaccgctccactggccttactgaaggcttagaatatgaacaccgtgtcacagccattaatgcaagagggtctgggaaaccaagtcgtccttccaaacccatcgttgccatggatccaattgctcctccaggaaagccacaaaacccaagagttactgatacaacaaggacatcagtctccctggcctggagtgttccagaagatgaaggaggatctaaagtcacaggctacttgattgaaatgcaaaaagtagatcaacatgaatggaccaagtgtaacaccactccaaccaagattcgagagtatactctaacacacctacctcagggtgcagaatacaggttccgcgtcctagcttgtaatgctggtggacctggtgagcctgctgaggtaccaggaacagtcaaagtcactgaaatgcttgaatatcctgattatgaacttgatgaaagataccaagaaggtatctttgtaaggcaaggtggcgtcatcagacttaccataccaatcaaaggaaaaccattcccaatatgtaaatggaccaaggaaggccaggatattagtaagcgtgccatgattgcaacatctgaaacacacactgagcttgtgatcaaagaagcagacaggggtgattctggcacttatgacctggttctggaaaataaatgtggcaagaaggctgtctacatcaaggtcagggtgataggaagtcccaacagtccagaagggccactggaatatgatgacatccaagtccgctctgtgagggtcagctggagacctcctgctgatgatggtggtgctgacatcttaggctacatcctcgagagacgagaagtgcctaaagccgcctggtataccattgattccagagtccgaggtacatctctggtggtaaaaggcctcaaagagaatgtagaataccatttccgtgtttcagcagaaaaccagtttggcataagcaaacccttgaaatctgaggaaccagtcacaccaaaaacaccattgaatcctccagaacctccaagcaatcctccagaagtactcgatgtaaccaagagttctgttagcttgtcctggtcccggcccaaagatgatggtggttctagagtcacaggctactacatcgaacgcaaagagacatccactgacaagtgggtcagacacaacaagactcagatcaccaccacaatgtacactgtcacagggcttgttcccgatgctgagtatcagttccgcatcatcgcacagaatgatgttggcctgagtgagaccagccctgcttctgaaccagttgtttgcaaagatccatttgataaaccaagccaaccaggagaacttgagattctttcaatatccaaagatagtgtcactctacagtgggagaaacctgaatgtgatggtggtaaagaaattcttggatactgggttgaatatagacagtctggagacagtgcctggaagaagagcaataaggaacgtattaaggacaagcaattcacaataggaggtttgctggaagctactgagtatgaattcagggtttttgctgagaatgagactgggctgagcagacctcgcagaactgctatgtctataaagactaaactcacatctggagaggccccaggaatacgcaaagaaatgaaggatgttaccacaaaattgggtgaagctgctcaactctcatgccagattgttggaaggcctcttcctgacattaaatggtacagatttggtaaagagctcatacaaagccggaaatacaaaatgtcttcagatggacgcacacacactcttacagtaatgacagaggaacaggaagatgaaggtgtttatacctgcatagccaccaatgaggttggagaagtagaaaccagtagtaagcttctcctgcaagcaacaccgcagttccatcctggttacccactgaaagagaaatattatggagctgtgggttccacacttcggcttcatgttatgtacattggtcgtccagtacctgccatgacttggttccatggtcagaaacttttgcaaaactcagaaaacattactattgaaaacactgagcactatactcatcttgtcatgaagaatgtccaacgtaagactcatgctgggaaatacaaagtccagctcagcaatgtttttggaacagttgatgccatccttgatgtggaaatacaagataaaccagacaaacctacaggaccaattgtgatcgaagctctattgaagaactccgcagtgatcagctggaaaccacccgcagatgacggaggctcctggatcaccaactatgtggtggaaaaatgtgaggccaaggagggggctgaatggcaattggtgtcttcagccatctcagtgacaacctgtagaattgtgaacctcacagaaaatgctggctattacttccgggtttcagctcagaacactttcggcatcagtgaccctctagaagtgtcctcagttgtgatcattaagagtccatttgaaaagccaggtgctcctggcaaaccaactattactgctgtcacaaaagattcttgtgttgtggcctggaagccacctgccagtgatggaggtgcaaagattagaaattactaccttgagaagcgtgagaagaagcagaataaatggatttctgtgacaacagaagaaattcgagaaactgtcttttcagtgaaaaaccttattgaaggtcttgaatacgagtttcgtgtgaaatgtgaaaatctaggtggggaaagtgaatggagtgaaatatcagaacccatcactcccaaatctgatgtcccaattcaggcaccacactttaaagaggaactgagaaatctaaatgtcagatatcagagcaatgctaccttggtctgcaaagtgactggtcatccaaaacctatcgtcaaatggtacagacaaggcaaagaaatcattgcagatggattaaaatataggattcaagaatttaagggtggctaccaccagctcatcattgcaagtgtcacagatgatgatgccacagtttaccaagtcagagctaccaaccaagggggatctgtgtctggcactgcctccttggaagtggaagttccagctaagatacacttacctaaaactcttgaaggcatgggagcagttcatgctctccgaggtgaagtggtcagcatcaagattcctttcagtggcaaaccagatcctgtgatcacctggcagaaaggacaagatctcattgacaataatggccactaccaagttattgtcacaagatccttcacatcacttgttttccccaatggggtagagagaaaagatgctggtttctatgtggtctgtgctaaaaacagatttggaattgatcagaagacagttgaactggatgtggctgatgttcctgacccacccagaggagtcaaagttagtgatgtctcacgagattctgtcaacttaacatggactgagccagcctctgatggtggcagcaaaatcaccaactacattgttgaaaaatgtgcaactactgcagaaagatggctccgtgtaggacaggcccgagaaacacgttataccgtgatcaacttatttggaaaaacaagttaccagttccgggtaatagctgaaaataaatttggtctgagcaagccttcagagccttcagaaccaaccataaccaaagaagataagaccagagctatgaactatgatgaagaggtagatgaaaccagggaagtctccatgactaaagcatctcactcttcaaccaaggaactctatgagaaatatatgattgctgaagatcttgggcgtggtgagtttggaattgtccatcgttgtgttgaaacatcctcaaagaagacatacatggccaaatttgttaaagtcaaagggactgatcaggttttggtaaagaaggaaatttccattctgaatattgctaggcatagaaacatcttacacctccatgaatcatttgaaagcatggaagaattagttatgatctttgagtttatatcaggacttgacatatttgagcgcattaacacaagtgcttttgaacttaatgaaagagaaattgtaagttatgttcaccaggtctgtgaagcacttcagtttttacacagtcataatattggacactttgacattagaccagaaaatatcatttaccaaaccagaagaagctctaccattaaaatcatagaatttggtcaagcccgtcagctgaaaccaggggacaacttcaggcttctattcactgccccagaatactatgcacctgaagtccaccagcatgatgttgtcagcacagccacagacatgtggtcacttggaacactggtatatgtgctattgagtggtatcaacccattcctggctgaaactaaccaacagatcattgagaatatcatgaatgctgaatatactttcgatgaggaagcattcaaagagattagcattgaagccatggattttgttgaccggttgttagtgaaagagaggaaatctcgcatgacagcatcggaggctctccagcacccatggttgaagcagaagatagaaagagtcagtactaaagttatcagaacattaaaacaccggcgttattaccacaccctgatcaagaaagacctcaacatggttgtgtcagcagcccggatctcctgtggtggtgcaattcgatctcagaagggagtgagtgttgctaaagttaaagtggcatccattgaaattggcccagtttctgggcagataatgcatgcagttggtgaagaaggaggacatgtcaaatatgtatgcaaaattgaaaattatgatcagtctacccaagtgacttggtactttggcgtccgacagctggagaacagtgagaaatacgaaatcacctacgaagatggagtggccatcctctatgtcaaagacattaccaaattagatgatggtacctacagatgcaaagtagtcaatgactatggtgaagacagttcttatgcagagctatttgttaaaggtgtgagagaagtctatgactattactgccgtagaaccatgaagaaaattaagcgcagaacagacacaatgagactcctggaaaggccaccagaatttaccctgcctctctataataagacagcttatgtaggtgaaaatgtccggtttggagtaactataactgtccacccagagcctcatgtaacatggtataaatcaggtcagaaaatcaaaccaggtgacaatgacaagaagtacacatttgagtcagacaagggtctttaccaattaacaatcaacagtgtcactacagatgatgacgctgaatatactgttgtggcaaggaacaaatatggtgaagacagctgtaaagcaaagctgacagtaaccctacacccacctccaacagatagtaccttaagacccatgttcaaaaggttactggcaaatgcagaatgccaagaaggccaaagtgtctgctttgagatcagagtgtctggcatccccccaccaacattaaaatgggagaaagatggtcagccactgtccctcgggcctaacattgaaattatccatgaaggcttggattattatgctctgcacatcagggacactttgcctgaagacacgggttattatagagtcacagccactaacacagctgggtccaccagctgccaggctcacctacaagtggaacgcctgaggtacaagaaacaggaattcaagagtaaggaggagcatgagcgacacgtacaaaaacaaattgacaaaaccctcagaatggctgaaattctttctggaactgaaagtgtaccactgacacaggtagctaaagaggctctgagagaagctgctgtcctttataaaccggctgtaagcaccaagactgtaaaaggggaattcagacttgagatagaagaaaagaaggaggagagaaaactccggatgccttatgatgtaccagagccacgcaagtataagcagactaccatagaagaagaccaacgcatcaagcagttcgtgcccatgtctgacatgaagtggtataaaaagatacgtgatcagtatgaaatgcctgggaaacttgacagagttgtacagaaacgacccaagcgcatccgcctttcaagatgggaacagttctatgtgatgcctcttccacgcattacagatcaatacagacctaaatggcgtattcctaaactgtcccaagatgatcttgagatagtgagaccagcccgccggcgtacaccttctcctgattatgacttttactaccgacctagaagacgttctcttggggacatctctgatgaagaattactcctccccattgatgactacttagcaatgaaaagaacagaggaagagaggctgcgtcttgaagaagagcttgagttaggtttttcagcttcacccccaagtcgaagccctccacactttgagctttctagcctacgttactcttcaccacaagctcatgtcaaggtggaggaaacaagaaaagacttcaggtattcaacctatcacatcccaacgaaggctgaagctagtacaagttatgcagaactgagggaacggcatgcccaggctgcgtacagacagccaaagcaacggcaaagaatcatggctgagagggaggatgaagagttgcttcgcccagttacgaccacccagcatctctcagaatacaaaagcgaacttgacttcatgtcaaaggaggaaaagtctagaaagaaatcaaggcgacaaagagaagtgacagaaataacagaaattgaggaagaatacgaaatctcaaaacatgctcaaagagaatcatcctcatctgcgtctagactactgagacgacggcgctccctgtctccaacttatattgagttaatgaggccagtgtctgagctgatccggtcacgtccacaaccggctgaggaatacgaagatgacacagaaagaaggtcacctactccagagagaactcgcccacgatcccccagccctgtgtctagtgagagatcactctcgagatttgagaggtctgcaagatttgatatcttttccaggtatgagtccatgaaagctgctttaaaaactcagaagacatcagaaaggaagtatgaagttttgagtcagcagcctttcacactggaccatgcccctcgaatcacactgagaatgcgctcgcacagggtaccatgtggccaaaatacacgttttattttaaatgttcagtctaagccaactgccgaggttaaatggtaccacaatggtgtggaactccaagaaagcagtaagattcattacaccaacacgagtggagtcctcaccctggaaattctggactgtcatactgatgacagtggaacctaccgtgctgtgtgcaccaactacaagggcgaagcttctgactatgcaacgttggacgtgacaggaggggattataccacctatgcttcccaacgcagagatgaagaggtccccagatctgttttccctgagctgacaagaacagaggcgtatgctgtttcatcatttaagaaaacatctgagatggaagcttcgtcttctgtcagggaagtgaaatcacagatgacggagacaagggaaagtctctcctcatatgaacactctgcatctgcagaaatgaaaagtgctgcattagaagaaaagtcactggaagaaaaatccacaaccagaaagatcaagacgactttggcagcaagaattctaacaaagccacggtccatgaccgtctacgagggcgagtctgcaaggttttcttgtgacaccgatggtgagccggtaccaactgtgacctggctgcgtaaaggacaagtgctaagtacttctgcccgccaccaagtgaccaccacaaagtacaaatcaacctttgagatctcttcagtccaggcttccgatgagggcaattacagcgtggtggtagaaaacagtgaagggaaacaagaagcagagttcactctgactattcaaaaggccagggtaactgaaaaggctgtgacatcaccaccaagagtcaaatccccagagcctcgggtgaaatccccagaagcagttaagtctccaaaacgagtgaaatctccagaaccttctcacccgaaagccgtatcacccacagagacaaaaccaacaccaacagagaaagttcagcacctcccagtctctgccccaccaaagattactcagttcctgaaagcagaagcttctaaagagattgcaaaactgacctgtgtggttgaaagcagtgtattaagggcaaaagaggtcacctggtataaagatggcaagaaactgaaggaaaatgggcatttccagtttcattattcagcagatggtacctatgagctcaaaatcaataacctcactgaatctgatcaaggagaatatgtttgtgagatttctggtgaaggtggaacgtctaaaaccaacttacaatttatggggcaagcctttaagagtatccatgagaaggtatcaaaaatatcagaaactaagaaatcagatcagaaaaccactgagtcaacagtaaccagaaaaactgaaccaaaagctcctgaaccaatttcctcaaaaccagtaattgttactgggttgcaggatacaactgtttcttcagacagtgttgctaaatttgcagttaaggctactggagaaccccggccaactgccatctggacaaaagatggaaaggccattacacaaggaggtaaatataaactctctgaagacaagggagggttcttcttagaaattcataagactgatacttctgacagtggactttatacttgtacagtaaaaaattcagctggatctgtgtcctctagctgcaaattaacaataaaagctataaaagatactgaggcacagaaagtctctacacaaaagacttctgaaattacacctcagaagaaagctgttgtccaagaggaaatttcccaaaaagccctaaggtctgaagaaattaagatgtcagaggcaaaatctcaagaaaagttagccctcaaagaggaagcttcaaaggttctgatttctgaagaagtcaagaaatcagcagcaacctccctggaaaaatccattgtccatgaggaaatcactaaaacatcacaggcatcagaagaagtcagaactcatgctgagattaaagcattttctactcagatgagcataaacgaaggtcaaagactggttttaaaagccaacattgctggtgccactgatgtgaaatgggtactgaatggcgtagagcttaccaactctgaggagtaccgatatggtgtctcaggcagcgatcagaccctaaccatcaagcaagccagtcacagagatgaaggaatcctcacctgcataagcaaaaccaaggaaggaatcgtcaagtgtcagtatgatttgacactgagcaaagaactctcagatgctccagccttcatctcacagcctagatctcaaaatattaatgaaggacaaaatgttctctttacttgtgaaatcagtggcgagccatcccctgaaatcgaatggtttaaaaacaacctgccaatttctatttcttcaaatgtcagcataagccgctccagaaatgtatactcccttgaaatccgaaatgcatcagtcagcgacagtggaaagtacacaattaaggccaaaaatttccgtggccagtgttcagctacagcttccttaatggtccttcctctagttgaagaaccttccagagaggtagtattgagaacaagtggtgacacaagcttgcaaggaagcttctcgtctcagtcagtccaaatgtctgcctccaagcaggaggcctccttcagcagtttcagcagcagcagtgctagcagcatgactgagatgaaatttgcaagcatgtctgcccaaagcatgtcctccatgcaagagtcctttgtagaaatgagttccagcagctttatgggaatatctaatatgacacaactggaaagctcaactagtaaaatgcttaaagcaggcataagaggaattccgcctaaaattgaagctcttccatctgatatcagcattgatgaaggcaaagttctaacagtagcctgtgctttcacgggtgagcctaccccagaagtaacatggtcctgtggtggaagaaaaatccacagtcaagaacaggggaggttccacattgaaaacacagatgacctgacaaccctgatcatcatggacgtacagaaacaagatggtggactttataccctgagtttagggaatgaatttggatctgactctgccactgtgaatatacatattcgatccatttaagagggcctgtgcccttatactctacactcattcttaacttttcgcaaacgtttcacacggactaatctttctgaactgtaaatatttaaagaaaaaaaagtagttttgtatcaacctaaatgagtcaaagttcaaaaatattcatttcaatcttttcataattgttgacctaagaatataatacatttgctagtgacatgtacatactgtatatagccggattaacggttataaagttttgtaccatttattttatgacattttacaatgtaagttttgaaactaactgttggtaggagaaagtttcttatggaacgaataccctgctcaacatttaatcaatctttgtgcctcaacatactgttgatgtctaagtatgcctcagtgggttgagaaaatccccattgaagatgtcctgtccacctaaaagagaatgatgctgtgcatatcacttgatatgtgcaccaatacctactgaatcagaaatgtaaggcattggtgatgtttgcatttaccctcctgtaagcaacactttaacgtcttacattttctctgatgatgtcacacaaaattatcatgacaaatattaccagagcaaagtgtaacggccaacactttgttcgctcattttacgctgtctctgacataaggagtgcctgaatagcttggaaaagtaacatctcctggccatcccttcatttaaccaagctattcaagtattcctatgccagagcagtgccaactcttggaggtcccagagtgcagccaatgcctttgtgtggtagttctaaattttaattgcacctgaaaaacctgggcacctaagcaatgagccacagcaaaaagtaaagaacaacaacaaaataaagctgttgttaaattttaaacaatattactaattgcccaaaatgtcaatttgatgtagttcttttcatgcaagtataaattcaattgttagttataattgttggacctccttgagatagtaacaacaaaataaagcaagctatctgcacctcaaaa

SEQ ID NO: 2956 - DNA, 82603 bp, Homo sapiens
agcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcaagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgatttaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatcacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagagtacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaagtgcaagccctagataggcaaagttctgggaaagatgtaagagagtccaccaagtcccaggcagtggcagattcctctttcacaaaggaggagagcaaaatatctcaaaaggaaattaagtcatttcaaggatcatcatatgaatatgaagtgcaggtttttgaaagtgtatctcaaagttccatccacacagctgcatctgttcaagatacacagttgtgccatactgcatccctttcacaaattgcagaaagcactgagctatctaaggaatgtgctaaagagtccacgggtgaggcgcccaagattttcctgcatcttcaggacgtcactgtaaagtgcggtgacacggctcaattcctctgtgttttaaaagatgattctttcattgatgtaacctggactcacgaaggtgcaaagatagaggaatccgagagactgaaacaatcacaaaatggaaatattcagtttcttaccatatgtaatgttcagctggtagaccaaggactatacagctgcattgtacacaatgactgtggagagaggacaacgtcagcagtactaagtgtagaaggtgctcctgaatcaattttgcatgagaggattgaacaagagattgagatggaaatgaaagagttttctagttcttttctgtctgccgaggaagaaggacttcatagcgccgaacttcaattatctaaaataaatgaaacacttgaacttttgtctgaatctccagtttactcaactaaatttgattccgaaaaggaaggcactggcccaattttcatcaaagaagtgtcaaatgctgatataagcatgggggatgtggctacactgtctgtaactgtcattggcatccccaaacctaaaattcagtggttctttaatggagtgctattaaccccttctgctgactacaaatttgtttttgacggtgatgatcatagcctgatcattctgttcaccaaattggaggatgagggagagtatacatgtatggccagtaatgactatggaaagacaatatgtagtgcctatctaaaaattaattccaaaggagagggtcacaaagacactgaaacagaatcagcagtggcaaaatctctggaaaagctgggaggtccttgtcctcctcacttccttaaggagttaaaaccaattcgctgtgctcaagggcttcctgccatctttgagtacacagtggttggagagcctgcccctactgttacatggttcaaagaaaacaagcagctttgcaccagtgtttattacactatcattcataaccctaatggctctggaactttcattgtcaatgaccctcagagggaagacagtggcctctatatctgtaaagcagagaatatgttgggtgagtccacctgtgcagcagagctgcttgtgcttctggaagacacagacatgactgataccccctgcaaagcaaagtccacaccagaggctcctgaggattttccacagacacccttaaagggtcccgcagttgaagcacttgactcagagcaggaaattgcaacgtttgtaaaagacaccattttgaaagctgctttaattacagaagaaaaccagcaactatcttatgagcatattgctaaagccaatgaattgagcagtcagcttcctttgggagctcaggaattgcaatccattttggagcaagacaagctcactcctgaaagcaccagggaatttctttgcatcaatggcagtattcactttcagcctctcaaggaaccatctcccaacctacagctgcagattgtacagtcccagaaaaccttctccaaagaaggtattctaatgcctgaagagcctgagacacaggcagttctatcagataccgagaaaatcttcccaagtgccatgtccatagaacaaattaattcattaacagttgagcctctgaaaactttattagctgaacctgaagggaattatccacagtcttcaatagaacctccaatgcattcttatctaacctctgtggctgaggaagtactttcaccaaaagaaaagacagtatctgacaccaacagagagcaaagagtgactcttcaaaagcaagaggcacaaagtgcgctcatcttgagtcagagcttagctgagggacacgtggagagtctccagagtcctgatgtcatgatctctcaggtaaactatgagcccctagtcccttcagaacactcatgcacagaaggaggtaaaattttgatagaaagtgcaaatccactggaaaatgcagggcaagattctgcggtcagaattgaggaaggcaagtccttaagatttccactagcacttgaagaaaagcaggtactgctcaaagaagagcattctgacaacgtggtgatgcccccagaccaaatcattgagtctaaaagagagcccgtggcaataaagaaagtgcaggaggtacagggaagggaccttctttctaaggaaagcttgctttctggtattccagaagagcagagattaaacctgaaaattcaaatctgccgggctttgcaagcagccgtggccagcgagcagccaggtcttttctctgagtggctaagaaatattgaaaaggtggaggtcgaggctgtaaacatcacccaagagcccagacacatcatgtgcatgtaccttgttacttcggcaaagtctgtaacagaagaagtaaccatcattattgaagatgttgatcctcaaatggctaacctgaaaatggaacttagggatgctttgtgtgctattatatatgaggaaatagacatcctaacagctgagggtcctagaattcagcaaggagccaaaacaagtttgcaagaagaaatggattctttttcaggttcacagaaggttgaacccattactgaaccagaagttgaatctaaatatctgatctcaactgaagaggtcagttattttaacgtgcaaagtagggttaaatatttggatgccacacctgtcactaaaggggttgcttcagctgttgtctctgacgaaaaacaagatgagagtctgaaaccatcagaggaaaaagaggagtcttcctctgaaagtggtactgaggaggttgctacagtaaagatacaggaagctgagggtggcttaatcaaagaggatggccccatgatacatacacctttagtggacactgtttctgaggaaggtgatattgtacacctcacaacatccataacaaatgctaaagaggtgaattggtattttgagaataaactggtgccttcagatgaaaagttcaagtgtttacaagatcaaaatacatatacgctagtcatcgacaaagtaaataccgaagaccatcaaggagagtatgtctgtgaggccttgaatgacagcggaaaaacagcaacttcagccaaactcactgtagtaaaaagagctgccccagtgatcaagaggaaaatcgaacccctggaagtagcactgggccacctagccaaattcacctgtgagatccaaagtgctcccaatgtccggttccagtggtttaaagctggccgagaaatttatgagagtgacaagtgttctattcgatcttcaaagtatatctccagccttgaaatcctgagaacccaggtggttgactgcggcgagtatacatgcaaagcttccaatgagtatggcagtgtcagctgtacagccacactaactgtgacagtgcctggaggtgaaaagaaagttcgcaaattacttccggaacgtaaacctgaaccaaaggaagaagttgttctgaaaagcgttctaagaaaaagacctgaagaagaagaacctaaagtagaacctaaaaaactagaaaaagttaaaaaacctgcagtaccagaaccaccacctccaaaacctgttgaagaggttgaagtacctactgttacaaaaagggaaaggaagattcctgaaccaacaaaagtgcctgaaatcaagccagcaatacctctccctgcacctgaaccgaaaccaaagcccgaagcagaagtgaaaacaatcaaaccacctcctgtggaacctgaaccaacccccatcgctgccccagtaacagtgccagtggttggaaagaaagcagaagccaaagcacctaaggaagaggctgccaagccaaaaggtcctatcaaaggtgtacccaaaaagactccttcaccaatagaagccgaaaggagaaagttaaggccaggaagtggtggagagaaacctcctgatgaagccccgttcacctaccagctaaaggctgtgccactgaagtttgtgaaagaaatcaaagacatcatcttgacagaatcagagttcgttggctcttcagcaatctttgaatgtttggtctccccttccactgcaattacaacctggatgaaagacggtagcaatatccgtgagagtcccaagcacaggtttattgcagatggtaaagacagaaagctgcacatcattgatgttcaactttccgatgctggtgaatacacctgtgttttacgtttgggaaacaaagaaaagacctccacggctaaacttgttgtagaagaacttcctgtgcgttttgtaaaaacactggaagaggaagtcacagtggtcaaaggacagccattgtacttgagctgcgagttaaacaaagagcgtgacgtggtctggaggaaggatggcaagattgtggtggagaaacctggccgaattgtgccaggcgtcattggcttgatgcgggctctgaccatcaacgatgcagatgacacagatgctggaacatacacagttactgtggaaaacgccaacaacctggagtgttcatcttgcgtaaaagtagtagaagtcattagagattggctggtgaaacctatacgagaccagcatgtgaaacccaaggggacagctatttttgcctgtgatatagcaaaagatactccaaacattaagtggttcaaaggatatgatgaaatccctgcggaaccaaatgataagactgaaatactgagagatggaaatcatctgtacctcaaaattaagaatgctatgccagaagatattgctgagtatgcagtggaaattgaaggaaaaagataccctgcaaagctgacacttggagagcgtgaagttgaactgcttaaaccaatagaggacgttaccatttatgagaaagaaagtgcaagctttgatgcagaaatctcagaggcagacattcctggacaatggaaactgaaaggagaacttctaaggccctcacctacttgtgaaatcaaagcagaaggtggaaaacgcttcttaactttgcacaaagtcaaactggaccaagctggtgaagtcctctaccaggcccttaatgcaattacaactgccattttgacagtaaaagaaatcgaacttgactttgctgtgcccctgaaggatgtcactgttccagaaaggcgacaggctcgattcgaatgtgtcctcacccgagaggcaaatgttatatggtccaaaggacctgatataattaagtcatctgacaaatttgatatcatcgctgatggaaagaaacatattcttgttattaatgattctcaatttgatgatgaaggggtctatactgctgaggtggagggcaagaagacctcagctcggttgtttgtcacaggtataagactgaaattcatgtcacctcttgaagatcaaacagtaaaagaaggtgaaacagcaacttttgtttgtgaactttctcatgaaaaaatgcatgtagtctggttcaaaaatgatgccaaactccatacaagcagaacagtactcatctcttctgagggcaagactcacaaattggaaatgaaagaagtgacattggatgatatatctcagataaaagctcaagtcaaggagctgagctccacagcacagctgaaggtcttagaggccgatccctacttcactgtgaaattacatgacaaaactgcagtggagaaggatgagattactttgaagtgtgaagtgagcaaagatgtaccagtgaaatggttcaaagatggtgaagagattgtcccttcacccaaatattctatcaaggcagatggcctgcgccgcatcttaaaaatcaaaaaggcggaccttaaagataaaggcgaatatgtgtgtgactgtggcacagacaagaccaaggcaaatgttactgttgaggctcgactaataaaagtggaaaagcctctgtacggagtagaggtgtttgttggtgaaacagcccactttgaaattgaactttctgaacctgatgttcacggccagtggaagctgaaaggacagcctttgacagcttcccctgactgtgaaatcattgaggatggaaagaagcatattctgatccttcataactgtcagctgggtatgacaggagaggtttccttccaggctgctaatgccaaatctgcagccaatctgaaagtgaaagaattgcctcttatcttcatcacacctctcagtgatgttaaagtcttcgagaaagatgaggctaagtttgagtgtgaagtatccagggagcccaaaacattccgttggctaaaaggaacccaggaaatcacaggtgatgacagatttgagcttataaaggatggcactaagcattcaatggtgatcaagtcagctgcttttgaagatgaagcaaaatacatgtttgaagctgaagataagcacacaagtggcaaactgatcattgaaggaatccggctcaaattcctcacccctctcaaagatgtaactgccaaagagaaggaaagtgctgtatttactgtggagttatctcatgataacatccgagttaaatggttcaagaatgaccagcgcctacacaccaccaggtcggtctcaatgcaagacgaagggaaaactcattcgatcacattcaaagacctgtctattgatgacacctcccaaattagagtagaagctatggggatgagttcagaagctaaactcactgtgcttgagggagacccatattttacaggaaaacttcaagattatactggtgtagagaaagatgaagttattctacagtgtgaaattagcaaagcagatgcaccagtgaaatggtttaaggatgggaaggaaataaagccatccaaaaatgctgttattaaggcagatggcaagaaacgcatgctaatcctaaagaaagccttgaaatcagatattggacagtacacctgtgactgtgggacagataagacctcaggaaaacttgacattgaggatcgggaaattaaactggtgcgacccctgcacagtgtggaggtgatggagactgagacagcacgctttgaaaccgaaatctctgaagatgatatccacgccaactggaaactcaagggagaggccctactccaaacacctgattgtgaaattaaggaagaaggcaaaatacactcccttgttttgcacaactgtcgcctggaccagacgggtggggtggatttccaagctgccaatgttaaatctagtgcccacctccgagttaagccacgagtaattggtcttctgaggcctttaaaggatgtcaccgtgactgcaggggaaacagccaccttcgactgcgagctctcctacgaagatatcccagtggaatggtatctcaaagggaagaaactagagcccagcgataaggtggtcccacgttcagaaggaaaagttcatacacttactctgagggatgtaaagttagaagatgctggggaagtccaactaacagcaaaagatttcaaaactcacgccaacctctttgtgaaagaacccccagttgaattcactaagcctcttgaggaccagacggtcgaagagggagccactgcagtgctggagtgtgaagtctccagagaaaatgctaaggtgaaatggttcaaaaatgggacagaaatcctcaaaagcaagaagtatgaaattgttgctgatggcagggtcagaaaacttgttatacatgactgtaccccagaggatattaaaacatacacttgtgatgctaaggattttaagacttcctgtaacctgaatgtcgtgcctcctcatgtggaattcttaagaccactcaccgaccttcaagttagagaaaaagaaatggctcgatttgagtgtgaactttcccgagaaaatgctaaggttaagtggtttaaagatggtgctgaaattaaaaagggcaaaaaatatgacatcatatccaagggagcagtgcgcattcttgtcatcaacaaatgtctactggatgatgaagctgaatattcctgtgaagtaaggacagcgagaacttctggcatgctgacagttctggaagaagaagctgtctttaccaaaaatcttgccaacattgaagttagtgaaacagacactataaaactggtttgtgaagtctccaaacctggcgcagaagtgatttggtataaaggggatgaggagatcattgaaacaggaagatatgaaatactgactgaaggacggaagagaatcctggtcattcagaacgctcaccttgaggatgctggcaactacaactgtcgactcccaagctctcgaaccgatggcaaagtcaaagtacatgaactggctgctgaatttatctcaaagcctcaaaaccttgaaatacttgaaggagaaaaggctgaatttgtctgctctatatcaaaagaaagctttccagtccagtggaagagggatgataagacacttgaatctggagataaatatgacgttattgctgatggtaaaaagagggtcctagttgtgaaagatgccacattacaagatatgggcacttacgttgtcatggtaggggccgccagagcagcagctcacttgacagtcattgaaaaactcaggatcgtagttcctcttaaggacacccgggtgaaggaacaacaggaagttgtcttcaactgtgaagtcaatactgaaggtgccaaagccaaatggttcagaaatgaagaagctatatttgatagttcaaaatacatcattctccaaaaagacctagtctacaccctcagaattagagatgcacacttagatgaccaagccaactataatgtgtctttgaccaatcacagaggtgaaaatgttaaaagtgcagccaatctaatagtagaagaggaagaccttaggattgttgagcctcttaaagatattgaaacaatggagaagaaatctgtcacattctggtgcaaggtgaatcgtctcaatgtaacactgaagtggaccaaaaatggtgaagaagtgccttttgacaaccgtgtctcatacagagttgataagtacaagcacatgttaaccattaaagactgtggcttcccagatgaaggtgaatacattgtcactgctggacaagataaatctgttgctgagcttctcatcatagaagccccgacagaatttgtggaacacttggaagatcagacagtcactgagttcgatgacgctgtcttctcctgccagctctccagagagaaagccaatgtaaaatggtacagaaatgggagagaaatcaaagaaggcaaaaaatacaaatttgaaaaagatggaagtatacacagactcattataaaagattgcaggctggatgatgagtgtgaatatgcttgcggggtagaagacaggaagtctcgtgctagactttttgtggaagaaattcctgttgagatcatcaggcctccacaagatattcttgaagcccctggtgctgatgttgtctttttagcagaactcaataaagataaggtggaagtccaatggctaagaaataacatggttgttgtccagggtgataaacaccagatgatgagtgaaggaaagatacatcgactacagatttgtgatattaagccccgtgaccagggtgaatacagatttattgccaaagacaaagaagccagagctaagcttgaactggcagctgcaccaaaaatcaagacagctgaccaagaccttgtggttgatgttggcaagcctctgacaatggtggtgccatatgatgcctaccccaaagcagaagctgaatggtttaaagaaaatgaacctttatctacaaaaaccattgatactacggctgaacaaacttctttcagaattttagaagccaagaaaggagacaaagggaggtataaaattgtgcttcagaacaaacatggaaaagcagaaggattcatcaatttaaaagttattgatgttcctgggccagtacgtaacttagaagtgacagaaacatttgatggtgaagtgagccttgcttgggaagaacctttaactgatggtggaagcaaaatcataggttacgttgttgaaagacgtgacattaagagaaagacctgggttctggccacagaccgtgcagagagttgtgagtttactgtcactggtctacagaaaggaggagttgagtacctattccgtgtgagtgcaagaaacagagttggcactggtgagccagtagaaactgacaatcctgtagaagcaaggagtaaatatgatgttccaggccctcctttgaatgtaaccatcactgatgtgaatcgatttggtgtctcactgacatgggaaccaccagagtatgatggaggtgctgagatcacaaactacgtcattgaattaagagacaagacttctatcaggtgggatactgccatgactgtgagagctgaagacctgtctgcaactgttactgatgtggtagaaggacaggagtacagtttccgagtgagagcccaaaatcgaattggagttggaaaaccaagtgcagccacacccttcgtcaaagttgctgatccaattgagagaccaagtcctcctgtaaacctaacttcctcagatcagactcagtcatcagttcagctcaaatgggaacctcctctgaaagatggaggaagcccaatattaggctatataattgagcgatgcgaagaaggaaaagataattggattcgttgcaatatgaaacttgtccctgaactgacttacaaggttaccggattggaaaaaggaaataaatatttatatagagtatctgcagaaaataaagctggtgtttcagatccatctgaaattcttggtcctctcaccgctgacgatgcatttgttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattgctcgcccaagtgcacccaaagaattgaaatttggtgatataaccaaggactcagtacatttgacttgggaaccacctgatgatgatggaggaagtccgttaactggatacgttgttgaaaaacgagaagtcagccggaaaacatggactaaagttatggactttgtgactgatctagaattcacagttcctgatcttgttcaaggaaaagagtacttatttaaagtttgtgctcgtaacaaatgtggccctggagaacctgcatatgttgatgaacctgtaaatatgtcaactcctgcaacggtacctgacccaccagagaatgttaaatggagagatcgaacagccaatagcatcttcttaacatgggatccacctaaaaatgatggtggttcacgcatcaaaggatatatagttgaaagatgtccacgtggttctgataaatgggttgcctgtggagaacctgttgcagaaacaaaaatggaagtgacaggtcttgaggaaggcaaatggtatgcctaccgcgtgaaggccttaaacaggcagggtgctagcaaaccaagcagacccacagaggaaatccaggctgtggacacacaagaggccccagaaatcttcctcgatgtgaagctccttgctggtctcactgtaaaagctgggaccaagattgaacttcctgccaccgtaaccggaaaacctgaacctaaaataacttggacaaaggctgatatgattctgaagcaggacaaaagaattaccattgaaaatgtccctaagaaatccacagtgactattgttgatagtaagagaagtgacactggcacatatatcattgaggctgtgaatgtgtgtggccgggccactgctgtggtggaagtgaacgtcttagataaacccggaccaccagctgcctttgacatcacagatgtaaccaatgagtcatgtcttctaacatggaacccaccacgcgatgatggtggatctaagatcacaaactatgttgtggagagacgagcaactgatagtgaagtgtggcacaagctctcatccaccgtcaaggatacaaacttcaaggccaccaaattaatccccaataaagagtacatcttcagagttgctgcagaaaacatgtatggtgttggtgaaccagttcaggcctctccaataacagccaaatatcagtttgatccacctggtcctccaactcgcctagaaccttctgatatcactaaagacgcagtgactctcacatggtgtgagccagatgatgatggtggcagcccaatcacaggatactgggttgaaagactggatcctgatacagataaatgggttagatgcaataagatgccagtaaaggacacaacatacagagtgaaaggtctcactaataagaaaaaatacagattccgtgtgttggctgaaaatcttgctggacctggaaaaccaagcaaatcaactgaaccaatcttaataaaggatcccatagatcctccatggccccctggaaaaccaactgtaaaagatgtaggcaaaacatcagtaaggttgaattggacaaaaccagaacatgatggaggtgcaaagattgagtcttatgtcattgaaatgctgaagactggaacagatgagtgggtcagagtggcggaaggggttcccaccactcagcacttgctcccagggctcatggaaggacaggaatactcattccgagttagagctgtgaataaggctggggaaagtgaacccagtgaacccagtgaccctgtgctttgccgggagaagctatatcctccatcaccaccacgctggcttgaagttattaatatcacaaaaaatacagcagacctaaaatggacagttcctgagaaagatggagggtcccccatcaccaactacattgtggaaaagagagacgtcaggcgaaaaggctggcaaacagtggataccactgtcaaggacaccaagtgcacagtcaccccactgactgagggctctttatatgtgttccgagttgctgcagaaaatgctataggacaaagcgactacaccgaaattgaggactctgtgctggccaaagacacctttaccactcctggaccaccctacgccctggcagtggttgatgtgacaaaacgacatgttgacctaaagtgggagccacctaaaaatgatggtggaagaccaatacagagatatgtcattgagaagaaagaaaggttaggtacccgttgggtgaaagctggaaagactgcaggacctgactgtaacttcagagtaactgatgtcatcgaaggaacagaggtccagtttcaggttcgggctgaaaatgaagctggagttggccacccaagtgaacccacagaaatcctatccattgaagatccaacaagtcctccctcaccaccccttgacctacatgtgactgatgctgggagaaaacacattgccattgcttggaagcctccagagaaaaatggtggaagtcctatcataggataccatgttgaaatgtgtccagtaggcactgagaaatggatgagagttaattctcgcccaataaaggacttgaaattcaaggttgaagaaggtgttgttcctgacaaagaatatgtcctgagagtgagagcagtcaatgctattggtgtcagcgagccatctgaaatctctgaaaatgtggttgccaaagacccagactgcaagccaacaattgacctggagactcatgacattattgttattgaaggtgaaaagttaagcattcctgttcccttcagagctgtcccagttccaactgttagttggcataaagatggcaaagaagttaaagcaagtgatagattaacaatgaagaatgatcacatctctgcacaccttgaagttcccaagagtgtccgtgcagatgccggaatttataccattacactggagaataagctcggctcagcaacagcctcaatcaatgtcaaagtcataggcctacctggaccatgcaaagatattaaagcaagtgacattaccaagagttcttgtaagttaacttgggaacctccagaatttgatggtggaaccccaattcttcattatgtcctggagcgcagagaagctgggaggagaacatatataccagtcatgtctggtgagaacaaactgtcatggactgtgaaggatctcataccaaatggtgaatacttcttccgtgttaaagcagtcaacaaggttggtggaggagaatatattgaactgaaaaatccagtcattgctcaagatccaaagcaaccccctgatccacctgtagatgtagaggttcataatcctacagcggaggcaatgactattacatggaagccacctttgtatgatggagggagcaagataatgggctacatcatagagaagattgctaagggtgaagaaaggtggaagagatgcaatgaacacctggtaccaatcctgacctatacagcaaaaggacttgaagaggggaaagagtaccaattccgtgtgcgagcagagaacgccgcgggtattagtgaaccttctcgggctactcctccaaccaaagctgtagatcccattgatgcccccaaagtcattctgagaacaagcctagaagtgaaacgaggtgatgaaatagcacttgatgcaagtatttctggatcaccttacccaactattacatggataaaggatgaaaatgttattgtaccagaggaaattaagaagcgtgcagcacccttggttaggagaaggaagggtgaagttcaagaagaagaaccatttgtcctgcctctgacacagcgtttgagtattgacaacagcaaaaagggagaatctcagctacgcgtccgagattctctccgacctgaccatggtctgtatatgatcaaagttgaaaatgaccacggtattgcaaaagctccttgtactgtcagtgtgttagatacaccgggaccaccaatcaactttgtatttgaagatatcagaaagacctcagtcctttgtaaatgggaaccaccccttgatgatggtggcagtgaaatcataaactacactttggaaaagaaagacaagacaaaacccgactcagaatggattgttgtcacttcaacacttagacattgcaaatattcagtaacaaaactgattgaaggaaaagagtacctcttccgtgtaagagctgaaaacagatttgggccaggtccaccatgtgtttcaaagccacttgtggctaaagatccatttggaccacctgatgcaccagataagcccattgtggaagatgttaccagcaacagtatgctagtgaaatggaatgaaccaaaagataatggaagccccattttgggttactggcttgaaaaacgtgaagttaacagtacacattggtctcgtgtcaacaaaagccttctgaatgccttgaaagccaatgtagatggcttattagaaggactcacctatgtcttcagagtatgtgctgaaaatgcagctggacctggaaagttcagtccaccttcagatcccaaaacagcacatgatccaatctctcctcctgggccacctatcccaagagtcactgacacaagctctacaactattgaactagaatgggaacccccagctttcaatggtggtggggaaattgttggctattttgttgataagcagttggttggcacaaatgaatggtcacgctgcacagagaagatgatcaaggtccgtcagtacaccgtcaaagaaatccgagagggtgctgattacaaacttcgggtgagtgctgtcaatgccgcaggggaaggaccgcctggagaaacacaacctgttactgtggctgaaccacaagagcctccagctgtggaactggatgtttctgtcaagggtggaatacaaataatggctgggaagactcttagaattccagctgtggtgactggtcgccctgtacctacaaaagtatggaccaaagaagaaggggagctggataaagaccgtgttgtaatagacaacgttggaaccaaatctgaactaattatcaaggatgcactgcgaaaagaccatggcagatatgtgattacagctacaaatagctgtggttccaaatttgcagcagccagggtagaagtttttgatgtccctggtccagttcttgacttaaaacctgttgtaacaaacagaaaaatgtgtctacttaactggtctgatccagaagatgatggaggaagtgaaataacaggctttatcattgaaagaaaagatgccaagatgcatacttggagacaaccaatagagactgagagatctaaatgtgacatcacaggtctgcttgagggacaagaatataagttccgtgttattgccaagaacaagtttggctgtggccctcctgttgaaataggaccaattcttgcagttgatccactaggtcctccaacatctccagagaggctcacatacactgaaaggacaaagtccactatcacacttgactggaaagagccccgcagtaatggtggcagtcccatccaaggatatatcattgaaaaacggcgtcatgacaaacctgactttgaaagagttaacaagcgactctgcccaaccacatcttttctggttgaaaatcttgatgaacaccaaatgtatgagttccgtgtcaaagctgtcaatgaaattggtgaaagtgaaccatccctacctcttaatgtagtcatacaagatgatgaagtgcctccaactattaagttgcgtctgagtgttcgaggagacactatcaaagttaaggcaggagagcctgtccacatccctgcagatgtgacaggccttccaatgcctaagattgaatggtccaaaaatgaaactgtaattgaaaaacccactgatgcacttcagataaccaaggaagaggtatcccgaagtgaggcaaaaactgagcttagcattcccaaagcggtccgggaggacaaaggcacttacacagttactgcttccaatcgccttggctcagtgttccgaaatgttcacgttgaagtatatgaccgcccatccccaccaagaaatcttgctgttactgacattaaagctgaatcttgctacttgacatgggatgcccctcttgataatggtggcagtgaaatcacccattatgttattgacaaacgtgatgcaagtaggaagaaagcagaatgggaggaagtcaccaacactgctgtagagaaaagatatgggatctggaaacttatccccaatggtcagtatgagttccgagtcagggcagtgaataaatatggaatcagtgatgagtgcaaatcagataaagtagtcattcaagatccttatcgccttcctggacctccaggaaaaccaaaagttttggcacgcaccaaaggatcaatgctagtgagctggactcctcctttggacaatggtggctctccaattactggctactggctggagaaaagagaagagggaagtccttattggtcacgtgttagccgagcaccaataaccaaagtgggattgaaaggcgtggaatttaatgttcctcgtttgcttgaaggcgttaaataccagttcagagccatggcaataaatgctgcaggaattggtcctcccagtgaaccatcagatccagaggttgcaggagatcccatatttccaccggggccaccttcttgcccagaagttaaagataaaacgaagtcaagcatctcactaggatggaaacctccagccaaagatggtggcagcccaatcaaaggatacattgtagaaatgcaagaagaaggtactactgactggaaaagagtaaatgaaccagacaaacttataactacctgtgaatgtgtggtgcctaatctgaaagagctcaggaagtacagattcagagtgaaagctgtcaatgaagctggtgaatctgaaccaagtgatacaactggggagatccctgccactgatattcaagaggaaccagaagttttcattgacattggagcacaggactgtctggtttgtaaagctggctcacagattaggattcctgctgtcatcaagggacgcccaacaccaaaatcatcttgggaatttgatggaaaggcaaagaaagcaatgaaggatggagttcatgacatacccgaagatgcacagctggagactgctgaaaactcctcagtaattattattccggagtgtaaacgatctcatacaggcaaatacagcatcacagccaagaataaagcaggacaaaagactgcaaattgcagagttaaagtcatggatgtaccaggcccacccaaagatctgaaagtcagtgatatcacaaggggtagttgcagactttcatggaagatgccagacgacgatggaggagacaggatcaaaggctatgttattgagaagaggactattgatggaaaagcctggaccaaagtcaatccagactgtggaagcaccacatttgtagtgcctgatctcctctctgaacagcaatatttcttccgtgtgcgagcagaaaaccgttttggtattggcccacctgtggaaaccattcagaggaccactgccagagatccgatatatcctcctgatcctcctattaaactcaagattggcctcatcacaaagaacacagtgcatctgtcatggaaacccccgaagaatgatgggggctcccctgttacccactatattgttgagtgccttgcatgggaccctactgggacaaagaaagaagcctggaggcagtgcaataagcgtgatgtggaagaactgcaatttactgttgaagacctagtagaaggtggggaatatgaattccgagtcaaagctgtcaatgctgcaggagtcagcaagccttcagccactgttgggccctgtgactgtcaaagaccagacatgccaccatcaattgatctaaaagaattcatggaggttgaagaaggaaccaatgttaacattgtggccaaaattaaaggtgtgccattcccgacactaacctggtttaaagctcctccaaagaagcctgataacaaagaacctgttctctatgacacccatgtcaacaaactggtggtagatgatacttgcactttagttattccgcagtctcgcaggagtgacactggcttatataccatcacagctgtaaataatctgggaacagcatcaaaggagatgagactgaatgtcctgggtcgtcctggccctccagtgggacccataaaatttgaatctgtttcagcagatcaaatgacactatcttggtttccacctaaagatgatggtgggtctaagattacaaactatgtaattgagaaaagagaagctaacaggaagacatgggtccatgtctccagtgaacctaaggagtgcacgtacacgattcccaaattgctagaaggccatgaatatgtattccgaatcatggcccagaataaatatggcattggagaacctcttgacagtgaacctgaaacagcaagaaacctcttctctgtccctggagcaccagataaaccaacagttagcagcgtgactcgtaactccatgactgtcaactgggaagagccagaatatgatggaggctctcctgtgacagggtactggctggaaatgaaagacaccacttcaaagagatggaagagagttaaccgagatcctatcaaagccatgactttgggtgtttcttataaagtgactggtcttattgaaggttccgactatcaattccgggtatatgcaatcaatgctgctggcgtgggtccagcaagtctgccatcagacccagcgactgctagagatccaattgcccctcctggtcctccatttcccaaagtgacagattggactaaatcatctgcagatctggagtggtctcccccactaaaagatggtggatccaaagtaactggatacatcgttgaatataaagaagaaggaaaagaagaatgggaaaagggtaaagataaagaagtgagaggaacaaagctcgttgtgacaggattaaaggaaggagcattctacaaatttagagttagtgcagtcaacattgctggcattggagaacctggagaggtcacagatgtcattgaaatgaaggacagacttgtttcacctgaccttcagctagatgccagtgtcagagatagaattgttgtccatgctggaggggtgatccgaatcattgcctatgtgtctggaaagcctcctccaaccgtcacctggaacatgaatgaaagaaccttacctcaagaagccaccattgagaccacagccattagctcatccatggtcatcaagaactgccagaggagccatcaaggcgtctattctcttcttgccaaaaatgaagccggagaaagaaagaagacaattattgttgatgtattagatgttccaggtcccgttggaacaccattcctagctcacaacctaaccaatgagtcctgcaaactgacatggttttctccagaagatgatggaggctctccaatcaccaattatgtcattgaaaagcgtgaatctgaccgcagagcatggaccccagtgacatatacagttacccgacaaaatgctactgtccagggtctcattcaaggaaaagcctactttttccgaattgcggctgaaaatagtattggcatgggtccatttgttgagacatcagaggcacttgttatcagagagccaataactgtaccagagcgtcctgaagacctggaagtcaaagaagttactaaaaatactgtaactttgacttggaatcctcctaagtatgatggtgggtcagaaattattaactatgtcctagaaagtcggctcattgggactgagaagttccacaaagttacaaatgacaacttgcttagcagaaaatacactgttaaaggcttaaaagaaggtgatacctatgagtaccgtgtcagtgctgtcaacattgttggacaaggcaaaccatcattttgcaccaaaccaattacttgcaaggatgagctggcacccccaacgcttcacctcgacttcagagataagctcacgattcgagttggtgaagcttttgccctcactggccgttactcaggcaaaccaaagcctaaggtttcctggttcaaagatgaagctgatgtgctggaagatgatcgcactcatataaagactacaccagcaacacttgctttagagaagatcaaggccaaacgttcagattccggcaaatactgtgtggttgtggagaacagtacaggctctaggaaaggtttctgtcaagttaatgttgttgaccgtcctggaccaccagtaggaccagttagttttgatgaggtgaccaaagattacatggttatctcttggaagcctcctttagatgatggaggcagtaaaatcaccaattatattattgagaagaaggaagtgggtaaagacgtctggatgccagtgacatctgcaagtgctaaaacaacatgcaaagtttctaaactacttgaaggaaaagattatattttccggatacatgctgaaaatctgtatggaataagtgatcctctggtgtctgattcaatgaaagccaaagatcgtttcagggttcctgatgcacctgatcagccaattgttacagaagttaccaaagactctgcattagtaacctggaataagccacatgatggaggaaaacccatcacaaactacatcctggaaaagagagaaactatgtctaaacgatgggctagagttaccaaagatcctattcatccatacactaaatttagggttcctgatcttctagaaggatgtcagtatgaattccgggtttctgcagaaaatgaaattggtattggagatccaagcccaccatccaaaccagtctttgctaaagatccaattgctaaaccaagtccacctgttaatcctgaagcaatagatacaacatgcaattcagtcgatctaacttggcagccaccacgtcatgatggtgggagcaagattctgggttatattgttgagtaccagaaagttggagatgaagagtggagaagagccaatcacacccctgagtcatgtcctgaaactaaatataaagtcaccggtcttcgggacggtcaaacctataagtttagagtgttagcagtcaatgcagctggtgaatcagatccagctcatgttccggagccagtcctagtaaaagacaggcttgaaccccctgagttgattcttgatgccaacatggcaagagaacaacacattaaagttggtgatactctaagacttagtgccatcatcaaaggagtgccattcccaaaagtaacttggaaaaaagaagacagagatgctccaactaaagcaagaattgatgtgactccagttggtagcaagcttgaaattcgtaatgctgcccatgaagatggtggaatttattctttaacagtggagaatccagctggttcaaaaactgtctcagtaaaagtacttgtattagataaacctgggccacctagagatctggaagtcagtgaaattaggaaagattcatgttaccttacttggaaagaaccactggatgatggtggttctgttattaccaattatgtggttgagaggagagatgttgccagcgcccagtggtcacctctctcagctacatcaaagaaaaagagtcacttcgctaagcatctgaatgaaggcaaccagtacctcttccgagtagctgcggagaaccagtatggacgtggtccttttgttgaaacaccaaaaccaatcaaggctttggatcctctccatcccccagggccacccaaggacctgcaccatgtagatgttgacaagactgaagtctccctagtctggaataagccggatcgtgatggtggttctccaatcactggatatttggtagaatatcaagaagaaggcacccaggactggattaaatttaagactgtgacaaacttagagtgtgtggttactggactacaacaaggaaagacctatagattccgtgtaaaagctgaaaacattgtgggtcttggtctccctgacacaactatcccgatagaatgtcaagaaaaactagtgcctccatccgtggagctagatgtgaaattaattgaaggtcttgtggtaaaggctggaaccacagtcagattccctgctattataagaggtgtgcctgttcctactgcaaagtggacaaccgatgggagtgagattaaaaccgatgagcactacacagttgaaacagacaacttctcatcagtacttaccattaagaactgcttaaggagagacactggggaatatcaaatcacagtttccaatgcagccggtagcaaaacagtagccgtacatcttactgttcttgatgttcctgggccaccaacaggtcctattaatattctggatgttactcctgaacacatgactatctcatggcagccacctaaggatgatggaggaagccctgtgataaattatattgttgagaaacaagatacaaggaaagacacgtggggtgttgtctcttccggaagcagtaagacaaagctgaaaatcccacatctgcagaagggctgtgaatatgttttccgagttagagcagagaataagataggtgttggtcctccccttgactccacacctactgttgctaagcataaatttagtcctccgtctcctcctggtaaaccagtggttactgacattactgaaaatgcagcaacagtgtcttggaccctgccaaaatctgatggtggcagtccaataactggctactatatggaacgtcgagaagtaactggcaaatgggtgagggtcaacaaaacacctatcgctgacctgaagttcagagtgactggactctatgaaggaaatacatatgagtttagagtttttgctgaaaatcttgcaggactaagcaaaccatccccaagttctgatccaataaaagcttgccggcccatcaaaccacctggaccacctattaatcctaaactgaaagacaagagcagagaaacagctgatttggtgtggacaaagcctctcagtgatggtggtagccccattctaggatatgtagtggaatgtcagaaacctggcacggcacaatggaacaggattaataaagatgaactcattaggcaatgtgcctttagggtacctggactaattgaaggaaatgagtacagattccgtataaaggcagctaatattgtaggagagggtgagccaagagaactagcagaatctgtgattgcaaaagatatccttcatcctccagaagtagaacttgatgttacttgtcgtgatgttattaccgtgagagtaggccaaactatccgcattctagctcgagtcaaaggcagacctgaaccagacataacttggactaaggaaggcaaagtattggtccgagaaaagagggtggaccttattcaggatctacctcgtgttgagttacaaattaaagaagctgttagagctgatcatggcaagtatatcatctcagctaagaacagcagtggacatgcccaaggttcagccatcgttaacgtccttgacagacctgggccttgccagaatttgaaggttaccaatgtaaccaaagagaactgtacaatttcttgggaaaacccactagataatggtggctcagaaataacaaacttcatagtagaatatcgcaaaccaaaccagaaaggctggtcaattgttgcatcagatgtcactaaacgattaatcaaggccaaccttttagccaacaatgaatactatttccgagtttgtgcagagaataaagtaggtgttgggccaaccatcgaaacaaaaactcccattctggctattaaccctattgacagaccaggtgagcctgaaaaccttcacattgcagataaaggaaagacatttgtctatctaaagtggcggaggcctgactatgatggtggcagtccaaatctgtcatatcatgttgagagaaggcttaagggctccgatgactgggaaagagtgcataaaggaagcattaaagaaactcactacatggttgacagatgtgttgaaaaccagatttatgagttcagagtgcaaacaaagaatgaaggtggggaaagtgactgggtgaagacagaggaagttgttgtgaaagaagacttacaaaaaccagtacttgatctgaaattaagtggggtcctaactgtcaaagcaggggacaccattaggcttgaggcaggggttagaggcaaaccattcccagaagttgcatggaccaaggacaaagacgctacagacttaacaagatcaccaagggtcaagattgatacccgtgctgattcatctaaattttctcttactaaagcaaagcgaagtgatgggggtaaatatgtagttacggcaactaacacggctggcagttttgtggcctatgccactgtcaatgttttagataagcctggtcctgtgagaaatctgaaaattgttgatgtgtccagtgataggtgtactgtttgctgggatccaccagaagatgatggtggctgtgaaatccaaaattatattctagaaaaatgtgagacaaagcgaatggtttggtctacctattctgctactgtcttgacacctggtactacagtaacacgtctcatagaaggaaatgaatatattttcagagtccgtgcagaaaataaaataggcacagggcctccaacagaaagtaaaccagtcatagccaaaaccaagtatgataaacctggtcgccctgatcccccagaagtcactaaagtaagcaaagaagagatgactgtggtttggaatccacctgaatatgatggtggaaagtctataactggatactttttggagaaaaaggaaaagcattcaacacgatgggtccctgtcaacaagagtgcaatccctgagagacgtatgaaagtacagaatctcctcccagaccatgaatatcagttccgtgtcaaggcagaaaatgaaattggaattggagaaccaagcttgccttcaagaccggtggtggcaaaagaccccatagagccacctggtccaccaaccaatttcagagtggttgatacaaccaaacattccataactcttgggtggggaaaaccagtctatgatggtggtgcaccgatcattggatatgttgtggaaatgagaccaaaaatagcagatgcgtctcctgatgaaggctggaaacggtgtaatgctgcagcacagcttgtacgcaaggaattcactgttaccagcttggatgaaaaccaggaatatgagttcagggtgtgtgcccaaaaccaagttggtattgggcgccctgcagagctaaaggaagctatcaaacctaaagaaatactagaacctccggagattgatttggatgccagcatgaggaaactggtcatagtgagagcaggatgccctattcgtctctttgctatagtgagaggacgaccagcccctaaagtcacttggcgaaaagttggcattgataatgtggtcagaaaaggacaagttgatctggttgacactatggccttccttgtcatccccaattctacccgtgatgactcaggaaaatattccttaacacttgtgaacccagcaggagaaaaggctgtattcgtaaatgtcagagtattagacactcctgggcctgtgtctgatttaaaagtttcagatgtcactaaaacatcatgccatgtgtcctgggcccctcctgaaaacgacggtgggagccaagtgacacattatatcgtggagaaacgtgaggcagacagaaagacatggtcgaccgttaccccagaagttaagaaaacaagcttccatgtaaccaatcttgtccctgggaatgagtattacttcagagtaactgctgtcaacgaatatggccctggcgtcccaacagatgtcccaaaaccagtgcttgcatcagatcctctaagtgagccggatcccccaaggaaattagaagtgactgaaatgaccaagaacagtgccaccttagcctggttacctcccctacgtgatggaggtgctaaaatcgatggctacatcactagttacagagaagaagagcagcctgcagatcgctggacagagtactcagtggtaaaagatctgagccttgttgtcactggcctaaaggaaggaaagaaatacaaatttagagtagcggccagaaatgctgttggagtcagtttgccaagagaagctgaaggagtgtatgaagccaaagaacaactgttgccaccaaagatccttatgccagagcaaataactatcaaagctgggaaaaaactccgaattgaagcccatgtgtatggaaagcctcatcccacctgtaaatggaaaaaaggagaagatgaagttgtcacatccagccacctggcagtgcataaagcagacagctcttcaattctgatcataaaagatgtgactaggaaagacagtggttactacagcctcacagcagagaacagttctgggacagacactcagaaaatcaaagttgtagtcatggatgcccccggcccccctcagcctccatttgacatttctgatatagacgctgatgcttgctccctgtcatggcacatccctctggaggacggaggcagtaacatcaccaattatatagtggagaagtgtgatgtaagccgaggtgactgggtcacggctctagcttcagtcacaaaaacttcctgcagggttggaaagctgatcccaggccaggagtacatcttccgggtccgtgctgaaaaccgatttggcatttcagagcctctcacatctccaaagatggttgcgcagttcccatttggtgttcctagtgaaccaaagaatgcacgagtcaccaaagtcaacaaggactgtatttttgttgcttgggacagaccagatagtgatggagggagccccattattggttatctgattgaacgcaaggaaagaaacagtttgctgtgggtgaaagccaatgatactcttgtccggtcaactgaatatccttgtgctggccttgtagaaggtcttgagtattcattcagaatctatgccctaaacaaagctggatccagcccacccagcaaacccacagaatatgtaactgcaagaatgccagttgatcctcctgggaaacctgaggttattgatgtcaccaagagtactgtatctctgatctgggctcgtccaaagcatgatggaggcagtaaaattattggctatttcgtagaagcttgcaaacttcctggtgataaatgggtacggtgcaatactgcacctcaccagattccccaggaagagtacacagctactggcctagaagagaaagctcagtatcaatttagagctattgccaggaccgcggtaaacattagcccaccttctgaaccttctgatccagtgactatcctcgcagaaaatgtccctcccaggatagacctgagtgtggctatgaaatctttgcttactgtgaaagctggaactaatgtctgcttggatgctactgtttttggtaaaccgatgccaacagtttcttggaaaaaagatggcacactgctaaaaccagcagaaggcataaagatggccatgcagcggaatctgtgcaccttggagctattcagcgtgaaccggaaggactcaggagactataccattactgctgaaaattcaagtggttctaaatcagccaccattaagcttaaagtgttagataaaccgggtcctccagcatctgttaaaatcaacaaaatgtattcagatcgtgctatgctttcttgggaaccgcctcttgaagatggaggctcagaaatcaccaactatattgttgacaaacgtgaaacaagcaggcccaactgggctcaagtctctgcaactgtgcctatcaccagctgcagcgtggagaaacttatagagggccatgagtatcagttccgtatttgtgctgaaaataaatatggagtaggcgatccagtcttcactgaaccagcaattgccaaaaacccatatgacccaccaggacgctgtgatcctcctgttattagcaacataaccaaagatcacatgacagtcagctggaagccaccagcagatgatgggggctcacccatcactggctatttgcttgaaaagcgggaaacccaggctgttaactggactaaggtcaacagaaaacctattatagaaagaacattaaaagcaacaggtcttcaagaaggtaccgaatatgagttccgtgttacagctataaataaagctggaccaggcaaacccagtgacgcatccaaggccgcttatgctcgggaccctcagtatcctcctgcgccaccggctttccctaaagtatatgatacaactcgcagctctgtgagtctatcttggggcaagccagcctatgacggcggcagccctatcattggttatctcgttgaagtaaaacgggctgactccgataactgggtgaggtgcaacttaccacagaatctacagaaaacccgctttgaggttactggcctgatggaagacacacaatatcaattccgtgtgtatgccgttaataagattggatacagtgaccccagtgatgtgccagataaacactatcccaaggacatcttaattccacctgagggagaacttgatgcggacttaaggaagacactcatattacgtgctggagttactatgagactatatgtaccagtaaaaggacgcccacctccaaagattacttggtctaaaccaaatgtcaatctaagagacaggattggactggacataaagtcaactgactttgacactttcttgcgctgtgaaaatgtgaacaaatatgatgcaggaaaatatatcttaaccctggagaacagctgtggtaaaaaggaatataccattgttgtgaaagtgcttgatactcctgggccacctgtcaatgtgactgttaaggaaatatccaaagactctgcttatgttacctgggagcctcccattattgatggcggaagccccatcataaactatgtggtacaaaaacgtgatgcagagaggaaatcctggtctacagtgacaactgagtgctccaaaacaagcttcagagtagctaatttggaggagggaaaatcctacttcttccgagtgtttgctgaaaatgagtatggcattggtgatcccggtgaaactcgtgatgctgtcaaagcttcccaaactcctggaccagttgtggacctgaaagtgaggtctgtatctaagtcatcctgtagcattggctggaaaaagcctcacagtgatggtggaagtcggattattggatatgtagttgatttcctgactgaagaaaataagtggcaacgagttatgaaatccttaagcctacagtactctgcaaaagatttgactgaagggaaggaatataccttcagagtgagtgctgagaatgaaaatggagaaggaaccccaagcgaaatcactgttgtggcaagggatgatgttgtggctcctgatcttgacttaaagggtctacctgatttgtgctacttggctaaagaaaacagcaacttccggcttaagatccccataaaaggcaagccagctccatcagtctcctggaagaaaggggaagatcctctagcaactgacactagagtcagtgttgagtcatctgcggttaacacaactcttatagtgtacgattgccaaaaatctgatgctggaaaatacacaatcacacttaagaatgttgctggcaccaaggaaggaactatctccataaaggttgttggcaagcctggcatccccactggaccaatcaaatttgatgaagtcacagcagaagccatgaccttaaagtgggctcctccaaaggatgatggaggttctgaaatcaccaactatatcctagagaagagggattctgtgaacaacaagtgggtgacgtgcgcctcagctgtccagaaaaccacctttagagtaaccagacttcatgagggcatggaatataccttcagggtcagtgccgaaaataaatatggtgtaggggaaggcctgaaatcggagccaattgttgcgagacatccatttgatgtgcctgatgctcccccacctcccaatattgtggatgtcagacacgattcagtatctctaacttggactgaccccaagaaaactggtggttctccaattacagggtatcatctcgagttcaaggaaagaaacagccttttgtggaagagagctaacaagactccgataaggatgagagactttaaagtgacaggattaactgaaggtcttgaatatgaattccgagttatggcaatcaatttagcaggtgtgggcaagccaagcctaccatcagagcctgttgtggcactggacccaattgatcctcctggaaaacctgaggttattaacataacaaggaattcagtgactctcatttggactgaacctaaatatgacggtggtcataagttaactggatatatagtggagaagcgagatctaccttcgaagtcttggatgaaagccaaccatgttaatgtcccagaatgtgcctttactgtaactgaccttgttgagggtggaaaatatgaattcagaattagagcaaagaatacagcaggtgctatcagtgctccatcagaaagtacagaaaccattatttgcaaggatgaatacgaggcaccaacaattgtccttgatcccacaataaaagatgggctaacaattaaagcaggggataccattgttttgaatgccattagcattcttggcaaaccccttccaaaatcaagttggtccaaggcaggaaaagacattagaccatcagatatcactcagataacttcaaccccaacatcttccatgcttactatcaagtatgccactagaaaagatgcgggtgaatataccatcactgctaccaatccttttggcacgaaggtggaacatgtgaaggtaacagtccttgatgtacctggtcccccaggtcctgttgaaatcagtaatgtttctgctgaaaaagcaacacttacatggacacctcccttggaagatggcggctcaccaattaagtcctatatacttgaaaagagagaaaccagccgacttttgtggacagtggtttctgaagatattcagtcttgcaggcatgtggcaaccaaacttatccaaggaaatgagtacatcttccgggtctcagctgtaaaccactatggcaaaggagaacctgtacagtctgaacctgtcaaaatggtagacagatttggtccccctggccctcctgaaaaaccagaggtatcaaatgtcactaagaacactgccactgtcagctggaaaaggccagtggatgatggtggcagcgaaattacaggatatcatgtagaaaggagagaaaagaaaagcctgcgatgggtgagagcaataaaaacaccagtttccgatctcaggtgcaaagtaacaggactgcaagaaggaagcacctacgaattccgtgtcagtgcagaaaacagagcaggaattggtccacccagtgaggcttcagattctgttctgatgaaagatgcagcatatcctccaggaccaccttcaaatccgcatgtcactgatactaccaagaaatctgcttctttggcatggggcaagcctcattatgatggtggacttgaaatcactggctatgtcgtggagcatcaaaaagtaggagacgaggcctggataaaagataccacaggaaccgccctcagaatcactcagttcgttgttcctgatcttcagactaaagaaaaatacaacttcagaatcagtgccatcaacgatgcaggtgttggggagccagcggtgattccagatgttgaaatcgtagaacgggagatggctcctgattttgaactagatgccgagcttcgaagaacacttgttgttagagcaggactcagtattaggatatttgtgccaattaaaggtcgtcctgctcctgaagtgacatggaccaaagataacatcaacctgaaaaaccgagccaacattgaaaatacggaatcatttactcttctgattatcccagaatgtaacagatatgataccggtaaatttgtcatgaccattgaaaacccggctgggaagaaaagtggctttgtgaacgtcagagtcttggacacgccaggcccagtcctcaacctgcggcctacagacatcacaaaggacagtgtcaccctgcactgggacctccctctgatagatggaggctcacgtataacaaactacattgtagagaaacgtgaagcaacacggaaatcttattccacagccaccactaagtgccataaatgcacatataaagttaccggcttgtctgaagggtgtgaatatttcttcagagtgatggcagagaatgaatatggaattggtgagccaacagaaactacagagcccgtaaaagcctctgaagcaccatctccaccagacagccttaacatcatggacataactaagagcaccgtcagcctggcatggcctaagcccaaacacgatggtggcagcaagatcactggctatgtgattgaagcccaaagaaaaggctctgaccagtggacccacatcacaaccgtgaaagggttagaatgtgttgtgaggaatctaactgaaggagaggaatataccttccaagtgatggcagtgaacagcgcggggagaagtgcccctagagaaagcagacccgtcattgtcaaggagcagacaatgcttccagagctggatctccgtggcatctatcagaaactggtcattgccaaagctggtgacaacatcaaagttgaaattccagtgctcggtcgaccgaagcccacagtgacatggaaaaaaggagaccaaattcttaaacagacacagagagttaattttgaaaccacagcgacttcaaccattttaaatatcaatgagtgtgtcagaagtgatagtgggccctatccattaacagcaaggaacattgtaggagaggttggtgatgtcatcaccattcaagtccatgatatcccagggccacctactggaccaatcaaatttgatgaagtttcatctgattttgtaaccttctcttgggacccacctgagaacgatggtggtgtaccaataagcaactatgtagtggaaatgcggcagactgacagtactacctgggttgagttagcaaccaccgttatacgtactacctataaagccacccgccttactactggattagagtatcagttccgtgtaaaagctcagaatagatatggagttggaccaggcatcacatcagcatgcatagttgccaactatccatttaaggttcctggacctcctggtacccctcaggtaactgcagttaccaaggattcaatgacaattagctggcatgagccactttctgatggtggaagccccattttaggatatcatgttgaaagaaaagaacgaaatggtattctctggcagactgtgagcaaagctttagtaccaggcaacattttcaaatcaagtggacttacagatggtattgcttatgagttccgggtgattgcagaaaacatggcaggcaaaagtaagccaagcaagccatcagaacctatgttggctctggatcccattgacccacctggaaaaccagtacctctaaatattacaagacacacagtaacacttaaatgggctaagcctgaatatactgggggctttaaaattaccagttatatcgttgaaaagagagaccttcctaatggacggtggctgaaggccaacttcagcaacattttggagaatgaatttacagtcagtggcctaacagaagatgctgcatatgaattccgtgtgatcgccaaaaatgctgcaggtgccatcagtccaccatctgagccatctgatgctatcacttgcagggatgatgttgaggcaccaaagataaaggtggatgttaaatttaaggacacggttatattaaaagcaggtgaagcattcagactggaagctgatgtttcaggccgcccacctccaacaatggaatggagcaaagatggaaaagagctggaaggcacagcaaagttagaaataaaaattgcagatttctctactaatctggtaaacaaagattcaacaagaagggatagtggtgcctatacccttacagcgactaatcctggtggctttgctaaacacattttcaatgtcaaagttcttgacagaccaggcccacctgaaggacctttggctgtaactgaagtgacatcagaaaagtgtgtactatcatggttccctccactggatgatggaggtgccaaaattgatcattacatagtacagaaacgtgaaaccagcagattggcatggacaaatgtagcctcagaagtccaagtaacaaagctaaaggtcactaaactcttgaaaggcaatgaatacatattccgtgtcatggctgtaaataaatatggagtgggagagccactggaatcagagcctgtgcttgcagtgaatccttatggaccccctgatccgcccaaaaaccctgaagtgacaactattactaaagattcgatggttgtctgctggggacatcctgattctgatggtggaagtgaaatcatcaattatattgtggaacggcgtgataaagctggccaacgctggattaaatgcaacaaaaaaactcttactgatttaagatataaagtgtctggactgacagaaggacatgaatatgagttcaggattatggctgaaaatgctgctggaattagtgcaccaagtcctaccagtccattttacaaggcttgtgacactgtgtttaaacctggaccaccaggtaacccacgtgttctggatacaagcagatcatccatttcaatcgcttggaataaacctatctatgatggtggttcagaaatcactgggtatatggttgagattgccctgccagaggaagatgaatggcagattgtcactccaccagcaggactcaaggcaacttcgtatactatcactggcctcacagagaatcaggaatataagatccgcatctatgccatgaattccgaaggacttggggaacctgcccttgttcctggaactccaaaggctgaagacagaatgctgcctccagaaattgaactggatgctgacctgcgcaaagttgttactataagggcctgctgcaccctgagactttttgttcccatcaaaggaaggcctgcacctgaggtgaagtgggcccgggaccatggagaatctttagataaagctagcatcgaatccacaagctcttacaccctgcttattgttggaaatgtaaacagatttgacagtggcaaatatatactaactgtagaaaatagttcaggcagcaagtctgcatttgtcaatgttagagttctcgatacaccaggccccccacaggatctgaaggtaaaagaggtcactaagacatctgtcacactcacatgggacccacctctccttgatggaggttcaaaaatcaagaactatattgttgaaaagcgggaatcaacaagaaaagcatattcaactgttgcaacaaactgccacaagacttcctggaaggtagaccagcttcaagaaggctgtagctactatttcagggttctcgcagaaaatgaatatggcattgggctgcctgctgaaaccgcagaatctgtgaaagcatcagaacgacctcttcctccaggaaaaataactttgatggatgtcacaagaaatagtgtgtcactctcttgggagaaaccagagcatgatggaggcagccgaattctaggctacattgtggagatgcagaccaaaggcagtgacaaatgggccacgtgtgccacagtcaaggtcactgaagccactatcactggattaattcagggtgaagaatactctttccgtgtttcagctcagaatgaaaagggcatcagtgatcctagacaactgagtgtgccagtgatcgccaaagatcttgtcattccaccagccttcaaactcctgttcaatactttcactgtactggcaggtgaagacctaaaagttgatgttccattcattggccgccctaccccagctgtaacctggcataaagataatgtaccactgaagcagacaactagagtaaatgcagagagcacagaaaataattcactactgacaataaaggacgcctgccgagaagatgttggccattatgtggttaaactgactaactcagctggtgaagctattgaaacccttaatgttatcgttcttgacaaaccagggcctccaactggaccagttaaaatggatgaagtgacagctgatagtattactctttcctggggcccacccaagtatgatggtggaagttctatcaataattacattgttgagaaacgggacacttccacaaccacctggcaaattgtatcagctacagttgcaaggacaacaataaaggcttgcagactgaagactggatgtgaatatcagtttagaattgcagctgaaaacagatatgggaagagtacctacctcaattcagagcctactgtagcccaatatccattcaaagttcctggtcctcctggcactccagttgtcacactgtcctccagggacagcatggaagtacaatggaatgagccaatcagtgatggaggaagtagagtcattggctatcatctagaacgcaaggaaagaaatagcatcctctgggttaagttgaataaaacacctattcctcaaaccaagtttaagacaactggccttgaagaaggtgttgaatatgaatttagagtctctgcagagaacatcgtgggcattggcaagccgagtaaagtatcagaatgttatgtggctcgtgacccatgtgatccaccaggacggccagaggcaatcattgtcacaaggaattctgtgactcttcagtggaagaaacccacctatgacggtggaagcaagatcactggttatattgttgagaagaaagaattacctgagggccgttggatgaaagccagttttacaaatattattgacactcattttgaagtaactggcctagttgaagatcacagatatgagttccgggttatagcccgaaatgccgcaggagtgtttagtgagccttcagaaagcacaggagcaataacagctagagatgaggtagatccaccacgaataagtatggatccaaaatacaaagacacaatcgtggttcatgctggtgaatcattcaaggttgatgcagatatttatggcaaaccaataccaaccattcagtggataaaaggtgatcaggagctttcaaacacagctcgattagaaataaagagcaccgactttgccaccagtctcagtgtaaaagatgcagtacgtgtcgacagtggaaattacatactgaaggccaaaaatgttgcaggagaaagatcagttactgtgaatgtcaaggttcttgacagaccagggccacctgaaggacctgttgttatctcaggagttacagcagaaaaatgcacactagcttggaaacccccacttcaggatggtgggagtgacatcataaattatattgtggaaaggagagaaaccagccgcttagtttggactgtggttgatgccaatgtgcagactctcagctgcaaggttactaagcttcttgaaggcaatgaatatactttccgtataatggcagtaaacaaatatggtgttggtgaacctcttgaatctgagccagtagttgccaagaatccatttgtagtaccagatgcaccaaaagctccagaagtcacaacagtgaccaaggactcaatgattgttgtatgggaaagaccagcatctgatggtggtagtgaaattcttggatatgttcttgagaaacgggataaagaaggcattagatggacaagatgccataagcgtctgattggagagttgcgcctgagagtaactggactcatagaaaatcacgattatgagttcagagtttctgctgagaatgctgctggacttagtgaaccaagccctccttctgcttaccaaaaggcttgtgatcctatttataaaccaggacccccaaacaaccccaaagtcatagacataaccagatcttcagtattcctttcttggagcaaaccaatatatgatggtggctgtgaaattcaaggatacattgttgaaaaatgtgatgtgagtgttggtgaatggacaatgtgcactccaccaacaggaattaataaaacaaacatagaagtagagaagctgttggaaaagcatgaatacaacttccgtatctgtgctattaataaagctggagttggagaacatgctgacgtccctggacctattatagttgaagaaaaattagaagcaccagacattgatcttgacctagaactaaggaaaatcataaatataagggcaggtggctccttaaggttatttgttcctataaaaggtcgtcctacaccagaagttaaatggggaaaggtggatggtgaaatccgagatgcagctataattgatgtcactagcagtttcacctctcttgttcttgacaatgtcaaccgatatgatagtggaaaatatacgcttacattagaaaacagcagtggaacaaagtctgcctttgttactgtgagagttctggacacgccaagtccacctgttaacctgaaagtcacagaaatcaccaaagactcagtatcaattacatgggaacctcctttgttggatgggggatccaaaataaaaaattacattgttgagaaacgtgaagccacaagaaaatcatatgctgctgttgtaactaactgccataagaattcttggaaaatcgatcagctccaagaaggttgcagttattactttagagtcacagctgagaatgagtatggtattggccttcctgcccagactgctgatccaattaaggttgcagaagtgccacaacctcctggaaaaataactgtggatgatgtcaccagaaacagtgtctctctgagttggacaaaacctgaacatgatggtggcagtaaaatcattcagtatattgtggaaatgcaagctaaacacagtgagaaatggtcagagtgtgctcgagtaaagtctcttcaggcagtaattaccaacctaactcaaggggaagaatatctttttagagttgttgctgtaaatgaaaaggggagaagtgatcctcggtcccttgcagttccaatagttgccaaagatctggtaattgagccagatgtaaaacctgcattcagtagttacagtgtacaggttggccaagatttgaaaatagaagtgccaatttctggacgtcctaagccaaccattacctggactaaagatggtctcccactgaagcagaccacaagaatcaatgttaccgattcactggatctcaccacactcagtattaaagaaactcataaggatgatggtggacaatatggaatcacagttgccaatgttgttggtcagaagacagcatccatcgaaattgtaactctagataaacctgatcctccaaaaggacctgttaaatttgatgacgtcagtgctgaaagtattacattatcttggaaccctccattatatacagggggctgccaaatcaccaactacattgttcagaaaagagatacaaccaccacagtatgggatgttgtttctgctactgttgctagaactacactcaaagtgaccaaactgaaaactggtacagaataccaatttagaatatttgccgaaaacagatatggacaaagctttgccttagagtctgatccaattgtagctcaatatccctacaaagaaccaggccctccaggtacaccatttgccacagccatttccaaagactccatggtcatacagtggcatgaaccagtcaacaatggtggaagccccgtcataggttaccacctggagagaaaagaaagaaacagtattttgtggacaaaggtcaacaaaactattattcatgacacccaattcaaagcacagaatcttgaagaaggcattgaatatgaattcagagtgtatgctgaaaatattgttggtgtaggcaaagcaagcaagaattctgaatgctatgtagccagagatccctgtgacccaccaggaaccccagaaccaataatggttaaaagaaatgaaatcactttacagtggaccaaacctgtgtatgatggtggaagtatgattacaggctacattgtagagaaacgtgatttgcctgatggtcgttggatgaaagctagctttacaaatgtcattgaaactcaatttactgtgtcaggtcttactgaagatcaaagatatgaattcagagtcattgcaaagaatgcagctggtgcaataagtaaaccctctgacagtactggaccaataactgccaaggatgaggttgaactcccaagaatttcaatggatccaaaattcagagacacaattgtggtaaatgctggagaaacattcagacttgaggctgatgtccatggaaagcccctacctaccattgagtggttaagaggagataaggaaattgaagaatctgctagatgtgaaataaagaacacagatttcaaggctttacttattgtaaaagatgcaattagaattgatggtgggcagtatattttaagagcttccaatgttgcaggttctaagtcattcccagtaaatgtaaaagtattagatagaccaggacctccagaagggccagtccaggttactggagtcacttctgaaaaatgctctttaacatggtctccaccacttcaagatggtggcagtgacatttctcactatgttgttgaaaagcgagaaaccagtcgacttgcctggactgttgttgcttcagaagttgtgaccaattctctgaaagttaccaaactcttagaaggtaatgaatatgttttccgtataatggctgtcaacaaatatggtgttggagagcctttggaatctgcaccagtactaatgaaaaatccatttgtgcttcctggaccaccaaaaagcttggaagtcacaaatattgccaaagactccatgaccgtctgttggaaccgtccagatagtgatggtggaagtgagattattggttacattgtagagaaaagagacagaagtggcattcgatggataaaatgtaataaacgccgcattacagatttgcgtctaagagtgacaggattaacagaagatcatgagtatgaattcagggtctctgcagaaaatgctgctggagttggggaaccaagtccagctacagtttattataaagcctgtgatcctgtgttcaaacctggcccacctaccaatgcacacattgtagacaccactaaaaattcaatcacacttgcctggggtaaacccatctatgatggcggcagtgagatcttgggatatgtagtagaaatctgtaaagcagatgaagaagaatggcaaatagttactccacagactggcctgagagtcactcgatttgaaatttcaaaactcactgaacaccaagagtataaaatacgagtctgtgccctcaacaaagttggtttaggtgaggctacatcagttcctggtactgtgaaaccagaagataaacttgaagcacctgaacttgaccttgactccgaattaagaaaaggaattgttgtaagagctggtggatctgccagaattcacattccattcaaaggtcgtccaacgcctgagatcacttggtctcgagaggaaggtgaattcacagataaggtccaaattgaaaagggagtaaactatacccaactatcaatagataactgtgatagaaatgatgctggaaaatacattcttaagttggaaaacagcagtggatcaaagtctgcttttgtaactgtgaaagttcttgacactccaggaccaccacagaatttggcagtcaaagaagtgagaaaagattctgccttcctggtatgggagccacccatcattgatggaggggcaaaggtcaagaactatgtgattgacaaacgtgagtcaaccagaaaagcgtatgctaatgtgagtagtaaatgcagcaaaacaagttttaaagtggaaaaccttacagaaggagccatttattacttcagagtcatggctgaaaatgaatttggagttggtgttccagtggaaactgttgatgccgtgaaagctgctgaacctccttccccaccaggaaaggttacactcactgatgtgtcccagaccagtgcatcacttatgtgggagaaacctgaacatgatggcggtagcagagtcctggggtacgttgttgaaatgcagcccaaaggaactgaaaaatggagcattgtggctgaatccaaagtctgtaatgcagttgttactggtttgagttctggacaagaatatcagttccgtgtcaaggcttataatgagaaaggaaaaagcgatccaagagtgttgggtgttcctgtcatagccaaggacttgactatacagcctagtttaaagttaccatttaacacatatagtatccaagctggagaagatcttaaaatagaaattccagttataggccgaccaagacctaacatttcttgggtcaaagatggtgagcctcttaaacagacaacaagagtaaacgttgaagaaacagctacctcaactgttttgcacattaaagaaggtaacaaagatgactttggaaaatacaccgtaacggcaacaaatagtgcaggcacagcaacagaaaatctcagtgttatcgttttagaaaagcctggacctccagttggcccagttcggtttgatgaagttagtgcagactttgtagtcatatcttgggaacctccagcctatactggtggctgccaaataagcaactacattgtagagaagcgagatacaaccaccaccacttggcacatggtatcagcaacagttgcaagaacaacaattaaaataaccaaactgaaaacaggcacggagtaccagtttagaatttttgctgaaaacaggtatggaaaaagtgccccactggattctaaggcagttattgtacaatatccatttaaagaacctggaccacctggaactccttttgtgacatcaatctcaaaagatcagatgcttgtgcaatggcatgagccagtgaatgatggaggcaccaaaattattggctaccatcttgaacagaaagaaaagaacagtattttatgggtcaagttaaataagacccccattcaggacaccaaattcaaaacaactgggcttgatgagggccttgagtatgagttcaaagtttctgctgaaaatattgttggcattggcaagcctagcaaagtgtcagaatgctttgttgctcgtgatccatgtgacccacctggtcgccctgaagccattgttattacaagaaacaatgtcacactgaaatggaagaaacctgcctatgatggtggtagcaaaataacaggttatattgtagaaaagaaagatctacctgatggccgctggatgaaagccagctttaccaacgtattagaaactgaatttacagtgagtggacttgtagaagaccaaagatatgaatttagagtaattgcaagaaatgcagctggaaactttagtgaaccatctgatagtagtggtgccattactgcaagagatgaaattgatgcaccaaatgcctctctggatccaaaatataaagatgtcatcgttgttcatgcaggagagacttttgttcttgaagccgacatccgtggcaaacctatacctgatgttgtttggtcaaaagatggaaaagaacttgaagaaacagctgctagaatggaaattaaatctactattcagaaaacaactcttgttgtcaaagactgtatacggactgatggaggacaatatattctgaaactcagcaatgttggtggtacaaagtctatacccatcactgtaaaggtacttgacaggccagggcctcctgaagggcctctgaaagttactggagttactgcggaaaaatgttacctggcatggaacccacctttgcaagatggtggtgctaatatttcacattacatcattgaaaagagggagacaagccgactctcttggacccaggtttcaactgaggtacaggcccttaactacaaagttactaaacttcttcctggtaatgagtacattttccgtgtcatggctgtgaataaatatggaattggagagcccttggaatctgggcctgttacggcctgtaatccttataagccaccaggtcctccctcaacacctgaagtctcagcaatcaccaaagattctatggtagtaacatgggcacgcccagtagacgacggaggtaccgaaattgagggctacattcttgaaaaacgagataaggaaggcgttagatggaccaagtgcaacaagaaaacattaacggatctgcggctcagggtaactggtcttaccgaaggccattcctatgaattcagagttgctgctgaaaatgcagctggtgtgggagaacctagtgagccatctgttttctaccgtgcgtgtgatgccttgtatccaccaggtcccccaagcaatccaaaagtgacggacacttccagatcttctgtctccctggcatggagtaagccaatttatgatggtggcgcacctgttaaaggctatgttgtagaggtcaaagaagctgctgcggatgaatggacaacctgcactccaccaacaggattacaaggaaagcagttcacagtgaccaagcttaaagaaaacactgaatataacttccgtatttgtgccatcaattctgaaggtgtaggtgaacctgcaactctacctggctcagtggttgctcaggagaggatagagccaccagaaatagaactcgatgctgatctcagaaaggtggtcgttctgcgtgcaagtgctactttacgcttatttgtcactatcaaaggtcgaccagaacccgaagttaaatgggaaaaggcagaaggcattctcactgacagggctcagatagaggtgaccagctcatttacaatgttggtgattgataatgttaccagatttgacagtggtcggtataatctgacattagaaaataatagtggctccaaaacagcttttgttaacgtcagagttcttgactcaccaagtgcccctgtgaatttgaccataagagaagtgaagaaagactcagtgacgttgtcctgggaaccaccacttattgatggtggagctaagattacaaactacattgtcgaaaaacgagaaactacaagaaaagcctatgctaccattacaaataattgcactaaaactactttcagaattgaaaatctacaagaaggatgttcttactacttccgagtcttggcttccaatgaatatgggattggtttgccagctgaaacaacagaacccgttaaagtgtctgaaccacccctcccacctggaagagtaactcttgttgatgtgacccgtaatacagctacaattaagtgggagaaaccagaaagtgatggtggcagcaaaattactggttatgtggttgaaatgcagactaaagggagtgaaaagtggagcacctgcacacaagttaagactctagaagcaactatatctggcttaactgcaggagaagagtatgtcttcagggtagctgcagttaacgaaaagggaagaagtgatccaagacaacttggagtgccagtaattgcaagggatattgaaataaagccttcagttgagcttcctttccatactttcaatgtaaaggctagagaacaacttaagattgatgtgccattcaaaggaagacctcaagctactgtgaactggagaaaagatggtcagactcttaaagagacaactagagtcaatgtttcttcttcaaagactgtaacatcactatctattaaggaagcttcaaaggaagatgttggaacttatgaattatgtgtttcaaacagtgctggatccataacagttcctattactataattgtccttgacagaccaggacctccaggtcctatacgtattgatgaggttagttgtgacagcataaccatttcttggaatcctccagaatatgatggtggctgccaaattagcaattacattgttgaaaagaaagaaaccacctctacaacatggcacatagtttcacaagcagttgcaagaacatccattaaaatagttcgcctgacaacaggaagtgagtatcagttccgtgtttgtgcagaaaaccgctatggaaagagctcctacagtgaatcttcagctgttgttgcagagtatccattcagtcccccaggtcctcctggtactcctaaagttgtgcatgccacaaaatctaccatgcttgtaacctggcaagtgccagttaatgatggaggaagtcgagtaattggctatcatcttgagtataaagaaagaagcagcattctttggtcaaaagcaaataaaatcctcattgctgatactcaaatgaaagtctccggccttgatgaaggactgatgtatgagtatcgtgtatatgctgaaaatattgctggaattggtaaatgcagtaaatcttgtgaaccagtccctgcaagagatccttgtgaccctcctggacaacctgaagtcacaaatatcacaagaaaatcagtgtcacttaaatggtctaaaccacattatgatggtggagctaagatcacaggatacattgttgaacgcagagaactaccagatggccggtggctgaagtgcaattatactaatatacaagaaacatactttgaagtaactgaacttactgaagatcagcgttatgaattccgggtttttgcaaggaatgctgctgactcagttagtgagccatctgaatccactgggcctattatagttaaagatgatgttgagcctccaagagttatgatggatgtcaagttccgagacgttattgttgtcaaagctggagaggtccttaagataaatgcagacattgcagggcgacctctgccagtaatttcctgggccaaggatggtatagaaattgaagaaagagcaagaacagaaatcatctcaacagacaatcatactttgttaacagttaaagactgtataagacgagacactgggcaatatgtactaacactgaagaatgttgccggcactcggtctgtggccgttaattgcaaagtacttgataagcctggtccaccagcaggaccacttgaaataaatggcctcactgctgagaaatgctctctttcctggggacgtccccaagaagatggtggtgcagatatcgactattacatcgtagaaaaacgtgaaacaagccaccttgcatggacaatatgtgaaggagagttacagatgacatcctgtaaagtaaccaagttactcaaaggcaatgaatatatatttagagtaactggtgttaataaatatggtgttggtgagcccctagagagtgtagctataaaggcactagatccatttacagttccaagtccacccacgtctttggaaattacttctgtgaccaaagaatctatgacactttgctggtcaagacccgagagtgatggaggtagtgaaatatctggatatataattgaaaggcgagagaaaaatagcctaagatgggtgcgtgtaaacaaaaaaccagtttatgatctaagagtgaaatcaacaggacttcgggaaggatgtgaatatgaatatcgtgtttatgcagaaaatgctgctggcctaagtcttccaagtgaaacctctcccttaattagggcagaagatccagtgttcctaccatctcctccatccaaacccaaaattgtggactcaggcaagacaactataactattgcctgggttaagccgctgtttgatggtggggccccgataactggatatactgtagaatacaaaaaatctgatgacactgactggaaaacttccattcagagcttacgagggacagaatatacaataagcggactaacaacaggagctgaatatgttttcagagtaaaatctgtcaataaggttggtgctagtgaccccagtgatagctctgaccctcagatagcaaaggaaagagaagaagaacctttatttgatattgacagtgaaatgaggaagaccttgattgtcaaggctggtgcctcatttaccatgactgtgcctttccgaggaagaccagtacccaatgtcttgtggagtaagccagacactgacctccgtactagagcttatgttgataccacagactcccgtacatcactgaccattgaaaatgccaacagaaatgactctggaaagtacacattaacaattcagaatgttttgagtgctgcttcactgaccttagttgtcaaagttttagataccccaggtcctccaaccaacattactgtgcaagatgtaaccaaagagtctgcagtgttatcctgggatgttcctgaaaacgatggtggagcaccagtgaagaattaccacatagaaaaacgtgaggccagcaagaaagcatgggtctctgtgaccaacaactgtaaccgcctctcctacaaagttaccaatttacaagaaggagctatctattacttcagagtctctggagaaaatgagtttggtgttggtataccagctgaaacaaaggaaggagtaaaaataacagaaaaaccaagcccacctgaaaaacttggagtaacaagtatatccaaagacagtgtttccctgacctggctgaagcctgaacatgatggcggaagcagaattgtacactatgtcgttgaagcactagaaaaaggacagaaaaactgggttaaatgtgcagtggcaaagtcaacccatcacgttgtttccggtctgagagagaattctgaatactttttccgagtgtttgctgaaaatcaagctggcctgagtgacccgagagagcttctgcttcctgttcttattaaggagcaactagaaccacctgaaattgatatgaagaatttcccaagtcacactgtatatgttagagctggttcaaaccttaaagttgacattccaatctctggaaaaccacttcccaaagtgaccttatcaagagatggtgtcccccttaaggcaaccatgagatttaataccgaaattactgctgagaacctgaccatcaatctcaaagaaagtgttacagctgacgctgggagatatgaaatcactgctgccaactccagtggtacaaccaaagctttcattaacattgttgtgctagacaggcctggtcctccaactggccctgttgttattagtgatataactgaagaaagtgtgactctcaaatgggagccacctaagtatgacggtggaagtcaagttaccaactacattctactcaaaagagaaacaagtactgcagtgtggactgaagtgtctgcaacagttgcaagaaccatgatgaaagtcatgaaactgaccacaggagaagaataccaattccgcatcaaggcagaaaaccgctttggcatcagtgatcatatagattcagcttgtgtgactgtcaaactaccatacacaacacctggaccaccatctacaccatgggtcactaatgttactcgagaaagcatcactgtgggctggcatgaaccagtgtcaaatggaggcagtgcagtcgtaggctatcacctggaaatgaaagacagaaacagtattttatggcaaaaagccaacaaactggtcatccgcacaactcacttcaaagtcacaacaatcagtgctggacttatttatgaattcagggtgtatgcagaaaatgctgctggagttggaaaacctagccatccttctgaaccagtcttggcaattgatgcttgtgaacccccaagaaatgttcgtatcactgatatttcaaagaactctgtcagcctttcatggcaacaaccagctttcgatggaggtagcaagattacaggctacattgttgagagacgtgaccttccagatggcagatggaccaaggccagcttcaccaatgttactgaaactcaattcatcatctctggcttgactcagaattcccagtatgaattccgtgtctttgctaggaatgctgttggttccattagcaatccatctgaggttgtagggcccattacttgcatcgattcttatggtggtcctgtaattgatttgcctctagaatatacagaagttgtcaaatacagagcaggtacatctgtgaagctcagagctggcatttctggcaaacctgcgcctactattgagtggtataaagatgataaagaattacaaaccaatgcactggtgtgtgttgaaaataccacggacctcgcatctatactcatcaaagatgccgatcgccttaatagtggatgctatgaattaaaactaaggaatgccatgggctcagcctcagccaccatcagagtacagatccttgacaaaccaggcccacctggtggaccaattgaatttaagactgtaactgctgagaagatcacccttctctggcggcctccagctgatgatggtggtgcaaaaatcactcactacattgtggaaaagcgtgagacaagccgcgttgtgtggtctatggtgtctgaacatttggaagagtgcatcattacaaccaccaaaattatcaaaggaaatgaatacatcttccgggtccgagccgtgaacaaatatggaattggcgagccactggaatctgattccgttgtagccaagaacgcatttgttacacctgggccaccaggcataccagaagtgacaaagattaccaagaattcgatgactgttgtatggagcaggccaattgcagatggcggtagtgatataagtggctatttccttgaaaaacgagacaagaagagcctaggatggtttaaagtactaaaagagactatccgtgacaccagacaaaaagtaacaggactcacagaaaacagtgactatcaatacagagtttgtgctgtaaacgctgctggacagggtccattttctgaaccatctgaattctacaaagctgctgatcctattgatcctccaggtccacctgctaagataagaatcgcagattcaaccaagtcatccatcacccttggctggagtaagcctgtctatgatgggggcagtgctgttactgggtatgttgtcgagataagacaaggagaggaagaggaatggactactgtctctaccaaaggagaggtcagaactacagaatatgtggtatccaacctgaaacctggagtcaattactacttccgggtatctgctgtaaactgtgctggacaaggagaacctatagaaatgaatgaacctgtacaagctaaagatatacttgaggcaccagagattgacctggatgtggctctcagaacttctgttattgccaaagctggtgaagatgtacaagtgttgattccctttaaaggcagacctccacctactgtcacatggagaaaagatgagaagaatcttggcagtgatgccagatacagcattgaaaacactgattcatcctcattactcaccattcctcaagttactcgcaatgatacaggaaaatatattctcacaatagaaaatggagttggtgaacctaagtcttcaactgtgagtgttaaagtgcttgacacaccagctgcctgccagaaactacaggttaaacatgtttctcgaggcacagtcactttgctctgggatcctcctctcattgatggaggatctccaataattaattatgtcattgaaaagagagatgccaccaagagaacatggtctgtcgtgtcacacaaatgttctagcacatccttcaagctaatagatttgtcggagaagactccattcttcttcagagttcttgcagaaaatgaaattggaattggggaaccctgtgaaactacagagccagtgaaggctgctgaagtaccagctcctatacgtgatctctcaatgaaagactcaacaaagacatctgtcatcctcagctggaccaaacctgactttgatggtggtagcgtcatcacagaatatgttgtagaaaggaaaggtaaaggtgaacagacgtggtcccacgctggcataagtaagacatgtgaaattgaggttagccaacttaaggagcagtcagtcctggagttcagagtgtttgccaaaaatgagaaaggactgagtgatcctgtcactattgggccaattacagtgaaagaacttattattacacctgaagttgacctgtcagatatccctggggcacaagtcactgtgagaattgggcacaatgtgcaccttgaattaccttataagggaaaacccaaaccatccatcagttggctgaaagatggcttgccactgaaagaaagtgaatttgttcgcttcagtaaaactgaaaacaaaattactttgagtattaagaatgccaagaaggagcatggaggaaaatacactgttattcttgataatgcagtgtgtagaattgcagtccccattacagtcatcacccttggcccaccatcaaagcccaaaggacccattcgatttgatgaaatcaaggctgatagtgtcatcctgtcatgggatgtacctgaagataatggaggaggagaaattacttgttacagcatcgagaagcgggaaacttcacaaactaactggaggatggtgtgttcaagtgttgccagaacgactttcaaagttcctaatctagtcaaagatgctgagtaccagtttagagtgagagcagaaaacagatacggagtcagccaaccacttgtctcaagcattattgtggcaaaacaccagttcaggattcctggtcccccaggaaagccagttatatacaatgtgacttctgatggcatgtcactaacttgggatgctccagtttatgatggtggttcagaagttactggattccatgttgaaaagaaagaaagaaatagcatcctctggcaaaaagttaatacatcaccaatctctggaagagaatatagagccactggactggtagaaggtctggattaccaattccgtgtatatgctgaaaattctgctggcctaagctcacctagtgacccaagcaaatttaccttagctgtttctccagtagacccacctggcactcctgactacattgatgtcacccgggaaaccatcacacttaaatggaacccaccattgcgtgatggaggcagtaagattgtgggctatagcattgagaaacggcaaggaaatgaacgctgggtgagatgcaactttactgacgtcagtgaatgtcagtacacagttacaggactcagtcctggggatcgctatgagttcagaataattgcaagaaatgctgttggaactataagcccgccctcacagtcttctggcattattatgacaagagatgaaaatgttccaccaatagtagagtttggccctgaatactttgatggtctcattattaagtccggagagagccttagaattaaagctttggtacaaggaagaccagtgcctcgagtaacttggttcaaagatggagtggaaatcgaaaagaggatgaatatggaaataaccgacgtacttggatccaccagcctatttgttagagatgctactcgggaccatcgtggtgtatacacagtggaagccaaaaatgcatctggttctgcaaaagcagaaattaaagtgaaagtacaagatacaccaggaaaagtagttgggccaataagattcaccaatattactggggagaagatgactctgtggtgggatgccccactcaatgacggttgtgctcccataacccactacatcattgaaaaacgggaaaccagcagacttgcctgggcactaattgaggataaatgtgaagcccaaagttacactgccattaaactaataaacggcaatgaataccaattccgtgtttctgcagttaacaagtttggtgttggcaggccacttgattctgatccagtggttgctcaaatacaatatactgttcctgatgcccctggcattccagaacctagcaacataacaggcaacagcattaccctgacatgggcaaggccagaatcagatggtggcagtgaaattcaacagtatatccttgaaagaagagaaaagaaaagcacaagatgggtaaaagtgatcagcaaacgaccaatctctgaaacaagattcaaagtcactggtctgacagaaggcaatgagtatgaattccatgtcatggctgaaaatgctgcaggagttggacctgcaagtggcatctcaagactcattaaatgtagagagcccgtcaacccaccaggtcctcccacagtggtcaaagtaacagacacatcaaagacaactgtgagcttagaatggtccaaaccagtgtttgatggtggcatggaaataattgggtatattattgaaatgtgtaaggccgacttaggagactggcacaaggtgaatgcagaggcatgtgtgaaaacaagatatacagtcactgatctacaagcaggtgaagaatacaaattccgagttagtgctatcaatggtgctggaaaaggcgacagctgtgaagtgactggcacaattaaagcagttgaccggttaacagctcctgagttagacatagatgcaaacttcaaacagactcatgttgttagagctggggccagtattcgcctcttcattgcctaccaaggtagacctactcctacagctgtgtggagcaaaccagactctaaccttagccttcgggctgatatccatacaacagattccttcagcaccctcactgtggaaaactgcaacagaaatgatgcagggaaatatacccttactgtggaaaacaacagtggtagtaagtcaatcacattcaccgtgaaagtgctagacactccaggcccacctggcccaattaccttcaaagatgtgacccggggatctgctacattgatgtgggatgcccctcttcttgacggtggtgcccgaatccatcattatgtggtagagaaacgagaggcaagtcgccgtagttggcaggttatcagtgaaaaatgcactcgtcagatcttcaaggtcaatgacctggccgaaggtgttccgtactatttccgtgtttctgcagtaaatgagtatggtgttggtgagccctatgaaatgccagaaccaattgtagccacagaacagcctgctccacctaggagacttgatgttgttgatactagcaaatcctccgcagtcttagcttggcttaaacctgaccacgatggaggcagccggatcactggctacctgcttgaaatgagacaaaagggatctgacttctgggttgaagctggtcacaccaaacagctaactttcacagtagagcgtcttgttgagaaaactgaatatgaattccgtgtgaaggccaagaatgatgctggctatagtgaacccagagaagccttctcttctgtcatcattaaggagcctcaaatcgagcccactgctgacctcactggaattaccaatcagcttataacttgcaaagcaggaagcccatttaccattgacgtaccaatcagtggtcgtcctgcccccaaagtaacatggaaactggaagaaatgagacttaaagagacagatcgagtgagcattacaacaacaaaagacagaaccacactgactgtaaaggacagcatgagaggtgactctggaagatacttcttgaccctggaaaatacagctggtgttaaaacatttagcgtcacagttgtggtcattggaaggccaggtccagtaaccggccccattgaggtctcatctgtctcagctgaatcgtgtgtcctgtcatggggagaacctaaagatggaggaggcactgaaattactaattacatagttgaaaagcgtgaatcgggtacaacagcttggcagcttgtcaattccagtgtcaagcgcactcaaattaaagtcactcatctcacaaaatacatggaatattctttccgtgtcagttcagagaacagatttggtgtcagcaaacctctagaatcagcaccaataattgctgaacatccatttgtcccaccaagcgctcctaccagacctgaggtctaccatgtgtctgccaatgccatgtctattcgttgggaagaaccctaccacgatggtggcagtaaaatcattggctactgggttgagaagaaagaacgtaatacaattctttgggtgaaagaaaacaaagtgccatgcttagagtgcaactacaaagtaactggtttagtagaaggactggaatatcagttcagaacttatgcactcaatgctgcaggtgttagcaaggccagcgaagcttcaagacctataatggctcaaaatccagttgatgcaccaggcagaccagaggtgacagatgtcacaagatcaacagtatcactgatttggtctgccccagcgtatgatggaggcagcaaggttgtgggctacatcatagagcgtaagccagtcagtgaggtaggagatggtcgctggctgaagtgcaactacaccattgtatctgacaatttcttcaccgtgactgctctcagtgaaggagacacttatgagttccgtgtgttagccaagaatgcagcaggcgtaattagcaaagggtctgaatctacaggccctgtcacttgccgagatgaatacgctccacccaaagccgaactggatgcccgattacacggtgatctggttaccatcagagcaggttctgatcttgttctggatgctgcagttggtggcaaacctgaacccaaaattatctggaccaaaggagacaaggagctagatctctgtgaaaaagtctctttgcagtatactggcaaacgagcaactgctgtgatcaagttctgtgacagaagtgacagtggaaaatacactttaacagtgaaaaatgccagcgggaccaaggccgtgtctgtcatggtcaaagtgcttgattcccctggcccatgtggaaagctcaccgtcagcagagtaacacaggagaagtgcactttagcctggagccttccgcaggaagacggaggagcagaaatcactcactacatcgtggaaagacgcgagactagcaggctcaactgggtgattgttgaaggcgaatgcccaaccctatcctatgtcgttaccaggctcatcaagaacaatgagtacatattccgagtgagggcagtaaacaaatatggccctggtgtgcctgttgaatcagagccaattgtagccagaaactcattcactattccatcaccacccggcatacctgaagaagttgggactggcaaagagcatatcatcattcagtggacaaaacctgaatctgatggtggcaatgaaatcagcaactacctagtagacaaacgtgagaagaagagcctgcgctggacacgtgtcaacaaagactatgtggtgtatgataccaggctgaaggtgaccagcctgatggagggttgtgattaccagttccgggtgaccgcagtgaatgcagctggtaacagtgagcccagcgaagcttccaacttcatctcatgcagagaaccatcatatacccctggaccaccttctgctccaagagttgtggataccaccaaacacagcattagtttggcatggaccaaacccatgtacgatggtggtactgacattgtaggatatgttctggaaatgcaagagaaggacactgatcagtggtaccgagtgcataccaatgccacaataagaaatactgaattcactgtgccagaccttaaaatgggccagaaatattccttcagagttgctgccgtgaacgtgaagggtatgagcgaatacagcgaatcaattgctgaaattgagcccgtggaaagaatagaaataccagatcttgagcttgcagatgatctaaagaagactgtgaccatcagggctggggcctccttgcgcttgatggtgtctgtatctggaagaccacctcctgtcataacgtggagcaagcagggcattgaccttgcaagccgggcaattattgacaccactgagagctactcattgctaatagtggacaaagttaatcggtacgatgctggaaaatacacaattgaagctgaaaaccaatctggcaagaaatcagcaacagtccttgttaaagtctatgatactcctggtccctgtccttcagtgaaagttaaggaagtatcaagagattctgtgactataacttgggaaattcccacgattgatggtggagctccagtcaacaattacatcgttgagaagcgtgaagctgctatgagagcattcaaaacagtaactaccaaatgcagcaagacactttacagaatttctggacttgtagaaggaaccatgtactatttcagagtgctgccagaaaatatttatggcattggagaaccttgtgaaacatctgatgcagtactggtctcagaagtgcctttggtgcctgcaaagctagaagtggtcgatgtcaccaaatccactgttacccttgcctgggaaaaaccactctacgatggtggtagccgactcactggatatgttctcgaggcctgcaaagctggcacagagagatggatgaaggttgtcaccttaaaacccacagtcctagagcacactgttacttccttaaatgaaggtgaacaatacttatttagaataagggcacaaaatgagaaaggtgtgtcagaaccaagagagactgtcacagccgtgactgtacaagacctcagagtgttgccaacaatcgatctttctacaatgcctcagaagaccatccatgtcccagctggcagaccagtagagctggtgatacctattgctggccgtccacctcctgctgcttcctggttctttgctggttctaaactgagagaatcagagcgtgtcacagttgaaactcacactaaagtagctaaattaaccatccgtgaaaccactatcagagatactggagaatacacacttgaattgaagaatgttaccggaactacttcagaaaccattaaagttatcattcttgacaagcctggtccaccaacaggacctattaagattgatgaaattgatgctacatcaattaccatttcctgggaaccacctgaattggacggtggtgctccactgagtggttatgtggtagaacaacgtgacgctcatcgtccaggatggctgcccgtttctgaatcagtgactaggtccacgtttaagtttaccagactcaccgaaggaaatgagtatgtgttccgtgtggctgcaacaaaccgcttcgggattggctcttacttgcagtctgaggtcatagagtgtcgcagcagcatccgtattcctggacccccagaaacattacagatatttgatgtttcccgtgatggcatgacacttacttggtacccaccagaggatgacggtggctcccaagtgactggatatattgtggagcgcaaagaagtgagagcagatcgatgggtccgtgtaaataaagtacctgtgacaatgacacggtaccgctccactggccttactgaaggcttagaatatgaacaccgtgtcacagccattaatgcaagagggtctgggaaaccaagtcgtccttccaaacccatcgttgccatggatccaattgctcctccaggaaagccacaaaacccaagagttactgatacaacaaggacatcagtctccctggcctggagtgttccagaagatgaaggaggatctaaagtcacaggctacttgattgaaatgcaaaaagtagatcaacatgaatggaccaagtgtaacaccactccaaccaagattcgagagtatactctaacacacctacctcagggtgcagaatacaggttccgcgtcctagcttgtaatgctggtggacctggtgagcctgctgaggtaccaggaacagtcaaagtcactgaaatgcttgaatatcctgattatgaacttgatgaaagataccaagaaggtatctttgtaaggcaaggtggcgtcatcagacttaccataccaatcaaaggaaaaccattcccaatatgtaaatggaccaaggaaggccaggatattagtaagcgtgccatgattgcaacatctgaaacacacactgagcttgtgatcaaagaagcagacaggggtgattctggcacttatgacctggttctggaaaataaatgtggcaagaaggctgtctacatcaaggtcagggtgataggaagtcccaacagtccagaagggccactggaatatgatgacatccaagtccgctctgtgagggtcagctggagacctcctgctgatgatggtggtgctgacatcttaggctacatcctcgagagacgagaagtgcctaaagccgcctggtataccattgattccagagtccgaggtacatctctggtggtaaaaggcctcaaagagaatgtagaataccatttccgtgtttcagcagaaaaccagtttggcataagcaaacccttgaaatctgaggaaccagtcacaccaaaaacaccattgaatcctccagaacctccaagcaatcctccagaagtactcgatgtaaccaagagttctgttagcttgtcctggtcccggcccaaagatgatggtggttctagagtcacaggctactacatcgaacgcaaagagacatccactgacaagtgggtcagacacaacaagactcagatcaccaccacaatgtacactgtcacagggcttgttcccgatgctgagtatcagttccgcatcatcgcacagaatgatgttggcctgagtgagaccagccctgcttctgaaccagttgtttgcaaagatccatttgataaaccaagccaaccaggagaacttgagattctttcaatatccaaagatagtgtcactctacagtgggagaaacctgaatgtgatggtggtaaagaaattcttggatactgggttgaatatagacagtctggagacagtgcctggaagaagagcaataaggaacgtattaaggacaagcaattcacaataggaggtttgctggaagctactgagtatgaattcagggtttttgctgagaatgagactgggctgagcagacctcgcagaactgctatgtctataaagactaaactcacatctggagaggccccaggaatacgcaaagaaatgaaggatgttaccacaaaattgggtgaagctgctcaactctcatgccagattgttggaaggcctcttcctgacattaaatggtacagatttggtaaagagctcatacaaagccggaaatacaaaatgtcttcagatggacgcacacacactcttacagtaatgacagaggaacaggaagatgaaggtgtttatacctgcatagccaccaatgaggttggagaagtagaaaccagtagtaagcttctcctgcaagcaacaccgcagttccatcctggttacccactgaaagagaaatattatggagctgtgggttccacacttcggcttcatgttatgtacattggtcgtccagtacctgccatgacttggttccatggtcagaaacttttgcaaaactcagaaaacattactattgaaaacactgagcactatactcatcttgtcatgaagaatgtccaacgtaagactcatgctgggaaatacaaagtccagctcagcaatgtttttggaacagttgatgccatccttgatgtggaaatacaagataaaccagacaaacctacaggaccaattgtgatcgaagctctattgaagaactccgcagtgatcagctggaaaccacccgcagatgacggaggctcctggatcaccaactatgtggtggaaaaatgtgaggccaaggagggggctgaatggcaattggtgtcttcagccatctcagtgacaacctgtagaattgtgaacctcacagaaaatgctggctattacttccgggtttcagctcagaacactttcggcatcagtgaccctctagaagtgtcctcagttgtgatcattaagagtccatttgaaaagccaggtgctcctggcaaaccaactattactgctgtcacaaaagattcttgtgttgtggcctggaagccacctgccagtgatggaggtgcaaagattagaaattactaccttgagaagcgtgagaagaagcagaataaatggatttctgtgacaacagaagaaattcgagaaactgtcttttcagtgaaaaaccttattgaaggtcttgaatacgagtttcgtgtgaaatgtgaaaatctaggtggggaaagtgaatggagtgaaatatcagaacccatcactcccaaatctgatgtcccaattcaggcaccacactttaaagaggaactgagaaatctaaatgtcagatatcagagcaatgctaccttggtctgcaaagtgactggtcatccaaaacctatcgtcaaatggtacagacaaggcaaagaaatcattgcagatggattaaaatataggattcaagaatttaagggtggctaccaccagctcatcattgcaagtgtcacagatgatgatgccacagtttaccaagtcagagctaccaaccaagggggatctgtgtctggcactgcctccttggaagtggaagttccagctaagatacacttacctaaaactcttgaaggcatgggagcagttcatgctctccgaggtgaagtggtcagcatcaagattcctttcagtggcaaaccagatcctgtgatcacctggcagaaaggacaagatctcattgacaataatggccactaccaagttattgtcacaagatccttcacatcacttgttttccccaatggggtagagagaaaagatgctggtttctatgtggtctgtgctaaaaacagatttggaattgatcagaagacagttgaactggatgtggctgatgttcctgacccacccagaggagtcaaagttagtgatgtctcacgagattctgtcaacttaacatggactgagccagcctctgatggtggcagcaaaatcaccaactacattgttgaaaaatgtgcaactactgcagaaagatggctccgtgtaggacaggcccgagaaacacgttataccgtgatcaacttatttggaaaaacaagttaccagttccgggtaatagctgaaaataaatttggtctgagcaagccttcagagccttcagaaccaaccataaccaaagaagataagaccagagctatgaactatgatgaagaggtagatgaaaccagggaagtctccatgactaaagcatctcactcttcaaccaaggaactctatgagaaatatatgattgctgaagatcttgggcgtggtgagtttggaattgtccatcgttgtgttgaaacatcctcaaagaagacatacatggccaaatttgttaaagtcaaagggactgatcaggttttggtaaagaaggaaatttccattctgaatattgctaggcatagaaacatcttacacctccatgaatcatttgaaagcatggaagaattagttatgatctttgagtttatatcaggacttgacatatttgagcgcattaacacaagtgcttttgaacttaatgaaagagaaattgtaagttatgttcaccaggtctgtgaagcacttcagtttttacacagtcataatattggacactttgacattagaccagaaaatatcatttaccaaaccagaagaagctctaccattaaaatcatagaatttggtcaagcccgtcagctgaaaccaggggacaacttcaggcttctattcactgccccagaatactatgcacctgaagtccaccagcatgatgttgtcagcacagccacagacatgtggtcacttggaacactggtatatgtgctattgagtggtatcaacccattcctggctgaaactaaccaacagatcattgagaatatcatgaatgctgaatatactttcgatgaggaagcattcaaagagattagcattgaagccatggattttgttgaccggttgttagtgaaagagaggaaatctcgcatgacagcatcggaggctctccagcacccatggttgaagcagaagatagaaagagtcagtactaaagttatcagaacattaaaacaccggcgttattaccacaccctgatcaagaaagacctcaacatggttgtgtcagcagcccggatctcctgtggtggtgcaattcgatctcagaagggagtgagtgttgctaaagttaaagtggcatccattgaaattggcccagtttctgggcagataatgcatgcagttggtgaagaaggaggacatgtcaaatatgtatgcaaaattgaaaattatgatcagtctacccaagtgacttggtactttggcgtccgacagctggagaacagtgagaaatacgaaatcacctacgaagatggagtggccatcctctatgtcaaagacattaccaaattagatgatggtacctacagatgcaaagtagtcaatgactatggtgaagacagttcttatgcagagctatttgttaaaggtgtgagagaagtctatgactattactgccgtagaaccatgaagaaaattaagcgcagaacagacacaatgagactcctggaaaggccaccagaatttaccctgcctctctataataagacagcttatgtaggtgaaaatgtccggtttggagtaactataactgtccacccagagcctcatgtaacatggtataaatcaggtcagaaaatcaaaccaggtgacaatgacaagaagtacacatttgagtcagacaagggtctttaccaattaacaatcaacagtgtcactacagatgatgacgctgaatatactgttgtggcaaggaacaaatatggtgaagacagctgtaaagcaaagctgacagtaaccctacacccacctccaacagatagtaccttaagacccatgttcaaaaggttactggcaaatgcagaatgccaagaaggccaaagtgtctgctttgagatcagagtgtctggcatccccccaccaacattaaaatgggagaaagatggtcagccactgtccctcgggcctaacattgaaattatccatgaaggcttggattattatgctctgcacatcagggacactttgcctgaagacacgggttattatagagtcacagccactaacacagctgggtccaccagctgccaggctcacctacaagtggaacgcctgaggtacaagaaacaggaattcaagagtaaggaggagcatgagcgacacgtacaaaaacaaattgacaaaaccctcagaatggctgaaattctttctggaactgaaagtgtaccactgacacaggtagctaaagaggctctgagagaagctgctgtcctttataaaccggctgtaagcaccaagactgtaaaaggggaattcagacttgagatagaagaaaagaaggaggagagaaaactccggatgccttatgatgtaccagagccacgcaagtataagcagactaccatagaagaagaccaacgcatcaagcagttcgtgcccatgtctgacatgaagtggtataaaaagatacgtgatcagtatgaaatgcctgggaaacttgacagagttgtacagaaacgacccaagcgcatccgcctttcaagatgggaacagttctatgtgatgcctcttccacgcattacagatcaatacagacctaaatggcgtattcctaaactgtcccaagatgatcttgagatagtgagaccagcccgccggcgtacaccttctcctgattatgacttttactaccgacctagaagacgttctcttggggacatctctgatgaagaattactcctccccattgatgactacttagcaatgaaaagaacagaggaagagaggctgcgtcttgaagaagagcttgagttaggtttttcagcttcacccccaagtcgaagccctccacactttgagctttctagcctacgttactcttcaccacaagctcatgtcaaggtggaggaaacaagaaaagacttcaggtattcaacctatcacatcccaacgaaggctgaagctagtacaagttatgcagaactgagggaacggcatgcccaggctgcgtacagacagccaaagcaacggcaaagaatcatggctgagagggaggatgaagagttgcttcgcccagttacgaccacccagcatctctcagaatacaaaagcgaacttgacttcatgtcaaaggaggaaaagtctagaaagaaatcaaggcgacaaagagaagtgacagaaataacagaaattgaggaagaatacgaaatctcaaaacatgctcaaagagaatcatcctcatctgcgtctagactactgagacgacggcgctccctgtctccaacttatattgagttaatgaggccagtgtctgagctgatccggtcacgtccacaaccggctgaggaatacgaagatgacacagaaagaaggtcacctactccagagagaactcgcccacgatcccccagccctgtgtctagtgagagatcactctcgagatttgagaggtctgcaagatttgatatcttttccaggtatgagtccatgaaagctgctttaaaaactcagaagacatcagaaaggaagtatgaagttttgagtcagcagcctttcacactggaccatgcccctcgaatcacactgagaatgcgctcgcacagggtaccatgtggccaaaatacacgttttattttaaatgttcagtctaagccaactgccgaggttaaatggtaccacaatggtgtggaactccaagaaagcagtaagattcattacaccaacacgagtggagtcctcaccctggaaattctggactgtcatactgatgacagtggaacctaccgtgctgtgtgcaccaactacaagggcgaagcttctgactatgcaacgttggacgtgacaggaggggattataccacctatgcttcccaacgcagagatgaagaggtccccagatctgttttccctgagctgacaagaacagaggcgtatgctgtttcatcatttaagaaaacatctgagatggaagcttcgtcttctgtcagggaagtgaaatcacagatgacggagacaagggaaagtctctcctcatatgaacactctgcatctgcagaaatgaaaagtgctgcattagaagaaaagtcactggaagaaaaatccacaaccagaaagatcaagacgactttggcagcaagaattctaacaaagccacggtccatgaccgtctacgagggcgagtctgcaaggttttcttgtgacaccgatggtgagccggtaccaactgtgacctggctgcgtaaaggacaagtgctaagtacttctgcccgccaccaagtgaccaccacaaagtacaaatcaacctttgagatctcttcagtccaggcttccgatgagggcaattacagcgtggtggtagaaaacagtgaagggaaacaagaagcagagttcactctgactattcaaaaggccagggtaactgaaaaggctgtgacatcaccaccaagagtcaaatccccagagcctcgggtgaaatccccagaagcagttaagtctccaaaacgagtgaaatctccagaaccttctcacccgaaagccgtatcacccacagagacaaaaccaacaccaacagagaaagttcagcacctcccagtctctgccccaccaaagattactcagttcctgaaagcagaagcttctaaagagattgcaaaactgacctgtgtggttgaaagcagtgtattaagggcaaaagaggtcacctggtataaagatggcaagaaactgaaggaaaatgggcatttccagtttcattattcagcagatggtacctatgagctcaaaatcaataacctcactgaatctgatcaaggagaatatgtttgtgagatttctggtgaaggtggaacgtctaaaaccaacttacaatttatggggcaagcctttaagagtatccatgagaaggtatcaaaaatatcagaaactaagaaatcagatcagaaaaccactgagtcaacagtaaccagaaaaactgaaccaaaagctcctgaaccaatttcctcaaaaccagtaattgttactgggttgcaggatacaactgtttcttcagacagtgttgctaaatttgcagttaaggctactggagaaccccggccaactgccatctggacaaaagatggaaaggccattacacaaggaggtaaatataaactctctgaagacaagggagggttcttcttagaaattcataagactgatacttctgacagtggactttatacttgtacagtaaaaaattcagctggatctgtgtcctctagctgcaaattaacaataaaagctataaaagatactgaggcacagaaagtctctacacaaaagacttctgaaattacacctcagaagaaagctgttgtccaagaggaaatttcccaaaaagccctaaggtctgaagaaattaagatgtcagaggcaaaatctcaagaaaagttagccctcaaagaggaagcttcaaaggttctgatttctgaagaagtcaagaaatcagcagcaacctccctggaaaaatccattgtccatgaggaaatcactaaaacatcacaggcatcagaagaagtcagaactcatgctgagattaaagcattttctactcagatgagcataaacgaaggtcaaagactggttttaaaagccaacattgctggtgccactgatgtgaaatgggtactgaatggcgtagagcttaccaactctgaggagtaccgatatggtgtctcaggcagcgatcagaccctaaccatcaagcaagccagtcacagagatgaaggaatcctcacctgcataagcaaaaccaaggaaggaatcgtcaagtgtcagtatgatttgacactgagcaaagaactctcagatgctccagccttcatctcacagcctagatctcaaaatattaatgaaggacaaaatgttctctttacttgtgaaatcagtggcgagccatcccctgaaatcgaatggtttaaaaacaacctgccaatttctatttcttcaaatgtcagcataagccgctccagaaatgtatactcccttgaaatccgaaatgcatcagtcagcgacagtggaaagtacacaattaaggccaaaaatttccgtggccagtgttcagctacagcttccttaatggtccttcctctagttgaagaaccttccagagaggtagtattgagaacaagtggtgacacaagcttgcaaggaagcttctcgtctcagtcagtccaaatgtctgcctccaagcaggaggcctccttcagcagtttcagcagcagcagtgctagcagcatgactgagatgaaatttgcaagcatgtctgcccaaagcatgtcctccatgcaagagtcctttgtagaaatgagttccagcagctttatgggaatatctaatatgacacaactggaaagctcaactagtaaaatgcttaaagcaggcataagaggaattccgcctaaaattgaagctcttccatctgatatcagcattgatgaaggcaaagttctaacagtagcctgtgctttcacgggtgagcctaccccagaagtaacatggtcctgtggtggaagaaaaatccacagtcaagaacaggggaggttccacattgaaaacacagatgacctgacaaccctgatcatcatggacgtacagaaacaagatggtggactttataccctgagtttagggaatgaatttggatctgactctgccactgtgaatatacatattcgatccatttaagagggcctgtgcccttatactctacactcattcttaacttttcgcaaacgtttcacacggactaatctttctgaactgtaaatatttaaagaaaaaaaagtagttttgtatcaacctaaatgagtcaaagttcaaaaatattcatttcaatcttttcataattgttgacctaagaatataatacatttgctagtgacatgtacatactgtatatagccggattaacggttataaagttttgtaccatttattttatgacattttacaatgtaagttttgaaactaactgttggtaggagaaagtttcttatggaacgaataccctgctcaacatttaatcaatctttgtgcctcaacatactgttgatgtctaagtatgcctcagtgggttgagaaaatccccattgaagatgtcctgtccacctaaaagagaatgatgctgtgcatatcacttgatatgtgcaccaatacctactgaatcagaaatgtaaggcattggtgatgtttgcatttaccctcctgtaagcaacactttaacgtcttacattttctctgatgatgtcacacaaaattatcatgacaaatattaccagagcaaagtgtaacggccaacactttgttcgctcattttacgctgtctctgacataaggagtgcctgaatagcttggaaaagtaacatctcctggccatcccttcatttaaccaagctattcaagtattcctatgccagagcagtgccaactcttggaggtcccagagtgcagccaatgcctttgtgtggtagttctaaattttaattgcacctgaaaaacctgggcacctaagcaatgagccacagcaaaaagtaaagaacaacaacaaaataaagctgttgttaaattttaaacaatattactaattgcccaaaatgtcaatttgatgtagttcttttcatgcaagtataaattcaattgttagttataattgttggacctccttgagatagtaacaacaaaataaagcaagctatctgcacctcaaaa

SEQ ID NO: 2957 - DNA, 2678 bp, Homo sapiens
tagtcttctctctttcttaagcagtgataaaccttttaatgagaacaaaaaggaaataaattgctaactctgaaggaaccagtaagaaatacactgaagtatggtctgttgttttagaataatttgttaaatggaccagagtaatatagtggaacatgcatcaccttataccatatagtaactgattcttctaagtttacttgaacagatttcagtcaggaaaaaacattgctcaattgtgttcttcaatttattcaacaaacaattgaaaataatattttaaaggacataatctcttcatatcacatcttaacaattcttgaatgagatccagtttgtccatgccttgtaagtaagtttataacctactatgctttagggcctcctgctaccttaggttgacatatatttaagaaaaataatttcatttcaatagtagcataaacattagaaaaataaatttgctggaaacatgaatgcaatctaaaccaaatgtgattttaaaattatttctgccattaattccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttattcccttctattttaaaaataacttgattatggatttgtattctggcattggtttttgaaccattgtgctttcattctttctagtctgtctaaaaatcactggagcgtttaagatggcagctgactaacataggcctttgaggtcttttggtcttctaaaggaagaaggccaaattttgggcccagtttcttaaggatgttttcaaaatgtacagtggctaaaatcttgtaagcagtaattttgtgtttatgatggctgtctccaagtttgggggaaaataatggcaaaacaaaaaatcacatttgagtagttcttagagcaattcctagagatgtatttcttacctggcctttcctctctaccctgtatctttgcattatttaatacttggaaaaacccacatagcattaaaaacaaagtactactgaacaaagtgataaatacattttcttaaatctttcttttctaaccacaggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaaaaaaaaaaaaaaaaaaaaaaaaaaaaaaaaaaaaa

SEQ ID NO: 2958 - DNA, 5057 bp, Homo sapiens
aggtggactttatggtattgacagcatgccggatcttcgcagaaaaaaaactttgcctattgtccgagatgtggccatgaccctggctgcccggaaatctggactctccctggctatggtgattaggacatccctaaataatgaggaactgaaaatgcacgtcttcaagaagaccttgcaggcactgatctaccctatgtcttctaccatcccacacaattttgaggtctggacggctaccacacccacctactgttatgagtgtgaagggctcctgtggggcattgcaaggcaaggcatgaagtgtctggagtgtggagtgaaatgccacgaaaagtgtcaggacctgctaaacgctgactgcttgcagagagcagcagaaaagagttctaaacatggtgccgaagacaagactcagaccattattacagcaatgaaagaaagaatgaagatcagggagaaaaaccggccagaagtatttgaagtaatccaggaaatgtttcagatttctaaagaagattttgtgcagtttacaaaggcggccaaacagagtgtactggatgggacatctaagtggtctgcaaaaataaccattacagtggtttctgcacagggtctacaggcaaaagataaaacagggtctagtgatccatatgttacagttcaagttggaaagaacaaaagaagaacaaaaaccatttttggaaatttgaatccagtatgggatgagaagttttattttgagtgtcataactccacagatcgaatcaaagtcagagtatgggatgaagatgatgatattaaatccagagtcaagcaacatttcaaaaaggagtcagatgattttctgggacaaacaattgtagaagtgaggaccttgagtggagaaatggatgtctggtacaacttagagaaaaggacagataagtcagctgtatctggggccatacgattgaaaatcaatgtggagataaaaggagaagagaaggttgctccatatcatattcaatatacatgtttacatgagaatctgttccattacttgactgaagtgaaatctaatggtggagtgaaaatcccagaagtcaaaggggatgaagcctggaaggttttctttgatgatgcttcccaagaaatagttgatgaatttgctatgcgttatggaattgaatccatttatcaagctatgacgcacttttcatgtctgtcttctaaatacatgtgccccggtgtccctgccgtcatgagcaccttgctggctaatataaatgctttttatgctcacacaacagtttcaacaaacatacaggtttctgcctcagatcgatttgctgctaccaactttggtagggaaaaattcataaaactactggaccagttacataactctttgaggattgatctgtcaaagtatagggaaaactttcctgcaagcaatactgaaagactgcaagacctgaaatcaactgttgacctgttaacaagtatcaccttttttaggatgaaggttctggagctgcaaagccccccaaaagcgagcatggtggtgaaggactgtgtaagggcttgcctggattctacatacaagtatatttttgacaactgccatgaactctactcccagctaacagacccgagtaagaaacaggatattcctcgtgaagatcagggaccaaccaccaagaatttggatttttggccccaacttattacactgatggttactattattgatgaggataaaactgcctacacacctgtcctgaatcagtttcctcaagagctgaacatgggaaaaataagtgccgaaattatgtggactctttttgctctggatatgaaatatgcattagaagaacatgaaaatcagcggttatgcaagagcaccgattatatgaatttgcatttcaaagttaaatggttttataatgaatatgtgcgtgaacttcctgccttcaaggatgctgttcctgaatactccttgtggtttgaaccttttgtcatgcaatggctagatgaaaacgaagatgtgtcaatggaattccttcatggagcactgggaagagacaaaaaagatggattccagcagacatctgagcatgctctcttttcttgctccgtggttgatgtctttgctcagctgaatcagagctttgaaattattaagaaactggaatgccctaatcctgaagcattatctcacttaatgagaagatttgcaaagactatcaataaagtgctgctccagtatgctgcaattgtatcaagtgatttcagttcacattgtgataaggaaaatgtgccctgtatcttgatgaacaatattcaacaattgcgggtccagctggaaaaaatgtttgaatccatgggagggaaggagctagattctgaagctagtactattctaaaagaacttcaggttaagctcagtggggtcctggatgagctcagcgtcacttatggtgaaagtttccaggttataattgaagagtgtataaaacagatgagtttcgaactaaatcaaatgagagcaaatggaaacaccacatctaataagaacagtgcagcaatggatgcagagattgtgttaagatctcttatggattttttggacaaaacattaagtctctcagcaaaaatctgtgagaaaacagtcctaaagcgagttttaaaagagttatggaagctagttctcaacaaaatagaaaaacaaattgttcttcctcctctgacagatcaaacaggaccccagatgattttcattgcagctaaagatcttggacaattatccaaactgaaggagcacatgattcgagaggatgccaggggtctgacgccaagacaatgcgctataatggaggtagtcctggctaccatcaagcaatactttcatgcaggaggaaatggcctgaaaaagaatttcttggagaaaagcccagatcttcagtctctgagatatgctctcagtctttatacccaaactactgatgccttgataaagaaattcatagatactcaaacctcacagagtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcgaccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtacctaaaaatatagctaagttggtttttgaatataaaacagtttatgaatatgtgcattttctgtattgttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagcacat

SEQ ID NO: 2959 - DNA, 5062 bp, Homo sapiens
aggtggactttatggtattgacagcatgccggatcttcgcagaaaaaaaactttgcctattgtccgagatgtggccatgaccctggctgcccggaaatctggactctccctggctatggtgattaggacatccctaaataatgaggaactgaaaatgcacgtcttcaagaagaccttgcaggcactgatctaccctatgtcttctaccatcccacacaattttgaggtctggacggctaccacacccacctactgttatgagtgtgaagggctcctgtggggcattgcaaggcaaggcatgaagtgtctggagtgtggagtgaaatgccacgaaaagtgtcaggacctgctaaacgctgactgcttgcagagagcagcagaaaagagttctaaacatggtgccgaagacaagactcagaccattattacagcaatgaaagaaagaatgaagatcagggagaaaaaccggccagaagtatttgaagtaatccaggaaatgtttcagatttctaaagaagattttgtgcagtttacaaaggcggccaaacagagtgtactggatgggacatctaagtggtctgcaaaaataaccattacagtggtttctgcacagggtctacaggcaaaagataaaacagggtctagtgatccatatgttacagttcaagttggaaagaacaaaagaagaacaaaaaccatttttggaaatttgaatccagtatgggatgagaagttttattttgagtgtcataactccacagatcgaatcaaagtcagagtatgggatgaagatgatgatattaaatccagagtcaagcaacatttcaaaaaggagtcagatgattttctgggacaaacaattgtagaagtgaggaccttgagtggagaaatggatgtctggtacaacttagagaaaaggacagataagtcagctgtatctggggccatacgattgaaaatcaatgtggagataaaaggagaagagaaggttgctccatatcatattcaatatacatgtttacatgagaatctgttccattacttgactgaagtgaaatctaatggtggagtgaaaatcccagaagtcaaaggggatgaagcctggaaggttttctttgatgatgcttcccaagaaatagttgatgaatttgctatgcgttatggaattgaatccatttatcaagctatgacgcacttttcatgtctgtcttctaaatacatgtgccccggtgtccctgccgtcatgagcaccttgctggctaatataaatgctttttatgctcacacaacagtttcaacaaacatacaggtttctgcctcagatcgatttgctgctaccaactttggtagggaaaaattcataaaactactggaccagttacataactctttgaggattgatctgtcaaagtatagggaaaactttcctgcaagcaatactgaaagactgcaagacctgaaatcaactgttgacctgttaacaagtatcaccttttttaggatgaaggttctggagctgcaaagccccccaaaagcgagcatggtggtgaaggactgtgtaagggcttgcctggattctacatacaagtatatttttgacaactgccatgaactctactcccagctaacagacccgagtaagaaacaggatattcctcgtgaagatcagggaccaaccaccaagaatttggatttttggccccaacttattacactgatggttactattattgatgaggataaaactgcctacacacctgtcctgaatcagtttcctcaagagctgaacatgggaaaaataagtgccgaaattatgtggactctttttgctctggatatgaaatatgcattagaagaacatgaaaatcagcggttatgcaagagcaccgattatatgaatttgcatttcaaagttaaatggttttataatgaatatgtgcgtgaacttcctgccttcaaggatgctgttcctgaatactccttgtggtttgaaccttttgtcatgcaatggctagatgaaaacgaagatgtgtcaatggaattccttcatggagcactgggaagagacaaaaaagatggattccagcagacatctgagcatgctctcttttcttgctccgtggttgatgtctttgctcagctgaatcagagctttgaaattattaagaaactggaatgccctaatcctgaagcattatctcacttaatgagaagatttgcaaagactatcaataaagtgctgctccagtatgctgcaattgtatcaagtgatttcagttcacattgtgataaggaaaatgtgccctgtatcttgatgaacaatattcaacaattgcgggtccagctggaaaaaatgtttgaatccatgggagggaaggagctagattctgaagctagtactattctaaaagaacttcaggttaagctcagtggggtcctggatgagctcagcgtcacttatggtgaaagtttccaggttataattgaagagtgtataaaacagatgagtttcgaactaaatcaaatgagagcaaatggaaacaccacatctaataagaacagtgcagcaatggatgcagagattgtgttaagatctcttatggattttttggacaaaacattaagtctctcagcaaaaatctgtgagaaaacagtcctaaagcgagttttaaaagagttatggaagctagttctcaacaaaatagaaaaacaaattgttcttcctcctctgacagatcaaacaggaccccagatgattttcattgcagctaaagatcttggacagttatccaaactgaaggagcacatgattcgagaggatgccaggggtctgacgccaagacaatgtgctataatggaggtagtcctggctaccatcaagcaatactttcatgcaggaggaaatggcctgaaaaagaatttcttggagaaaagcccagatcttcagtctctgagatatgctctcagtctttatacccaaactactgatgccttgataaagaaattcatagatactcaaacctcacagagtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcggccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtacctaaaaatatagctaagttggtttttgaatataaaacagtttatgaatatgtgcattttctgtattgttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtaaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagcacat

SEQ ID NO: 2960 - DNA, 3696 bp, Homo sapiens
atagcacgccgcgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaaaaaaaaaaaaaaaa

SEQ ID NO: 2961 - DNA, 3555 bp, Homo sapiens
atagcacgccgcgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaatggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaaaaaaaaaaaaaaaa

SEQ ID NO: 2962 - DNA, 3949 bp, Homo sapiens
tccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttccaggctggtatggggagtgattctatttgtgtatctggtcataagagctttgagactatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcagatcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatggggtaaagtccgcatggaattagagggggaaagtctgcactggaacctgctgtggccattttttttctgttgttgctgcttctctagtggagttactgcagcttagggatggttcctggaagtggacacattttacaaaaacgttttttaaatacacgccagctcttcgagaagcacttttttccttccgtcatgcttcatactatattgtattgtactaacccctcatgctgggatgagcgactgcctagcaagcaacccactgcctactaacatcaagaggggctaaataaaactgcattttccttgcaagggacaacttctaccgtatgaatatatattatatttatgtattatattttgtacaatagttgatcttgaatgcagacttcatttgtatttttcgtggtactacaaaatgtgtagaagttatggcttttctttcattagggtcttgttaggtggttggcaagtaagttaaattgtatgttgcatttttttccatgctgttttaacttgtaaatatatatgtatacatgtggaagatattattattatctagattactttaagccttttatctgatgtattatcagtgaaaaccatgctgcttattccctaatacaatggttctcaaactttagtgtgtatcagaatcaagatgagggcttgtaaaatatagctggtcccaactcccagagtttccatttcaggaggtctgggatcaggcccaagaatttgcatttttaacaaattcctaggtgataactgataatgttggttcagggaacacactttcagaaccactgctttaatattttaaataagataatatgtgaggtgtcataaaaaccttcatcaaatccctatctcatttcatttcttaggcattttctctcttataaagtttcctggatttataaattttcattgattttactagaaagttttatttagcttttatttatttattgttctttttaagaaaaaaactgagagtttgaattaaaagtttaaatcattgctaggtccttagttattttttttcttttttctttttttttatttgaagccgtgttgaaatccttgtctcctgtagacccagtggaacccataagtaattcagaaccatcaatgaattcagatatgggaaaagtcagtaaaaatgatactgaagaggaaagtaataatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatgtaaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaaaaaaaaa

SEQ ID NO: 2963 - DNA, 11145 bp, Homo sapiens
ttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcagggaataaaaagagctacagagacttctgaagtggagagtctgcgacctcctcggttcttcaatgaagatggagttatcagaccgtacaggttgagggatgggactggaaatcaaatgttacaggtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaa

SEQ ID NO: 2964 - DNA, 10135 bp, Homo sapiens
ttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcagggaataaaaagagctacagagacttctgaagtggagagtctgcgacctcctcggttcttcaatgaagatggagttatcagaccgtacaggttgagggatgggactggaaatcaaatgttacaggcatcaaaaagtttgatatgaaaagttaatgcatgactttgcaagtgaaagccaacagtagattttagtcttaaaatttacaaactacgtacagctgtttcagtattttgaatacaaagaaaaccttttgtattggtaacttttaataggaattttaatgaatctggtttttttatagggtgttcttagttctgcactggatttgctagatttgttggaagcctttgtaccttatgtatcctcgtcattggtggtacttacttaaccaattaaaccatttctgttgtggggttattaaaccactggtagcttttataccagatatataatccttatatccaattacacatgaagaaggaaaagcaaaactcaggaacactgctattgtgaattactcttggattcttgtgctttgcctttgaaaatgcttaaatggccatgaccctcttcctgctttattctagtgtagtctttataaaacttgtgggatttgataagcagttcacatgcaaaccagtatcttttaataatacaaagtagcatctggaacaatagacagtttgaagttagaatctgcttagacaactttcttacttggtaaattcgactttttaaaacctggattatgctgtaggtaactagtaatcatatataggctataccagtgtcatgttgtttctgtggtt

SEQ ID NO: 2965 - DNA, 10052 bp, Homo sapiens
ttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcagggaataaaaagagctacagagacttctgaagtggagagtctgcgacctcctcggttcttcaatgaagatggagttatcagaccgtacaggttgagggatgggactggaaatcaaatgttacagaaaattcaattctacagggagtggattatgactcacagtagcagtagtgatgatgatgatgatgatgatgatgatgatgagtcagatctaaaccattaaaattcatatgttctttattttacttggaatgtttcattaacatgttttgtatgacttataccataatgcccatatgtccatttatagggaggtaaaacacattttcttttaaaatgttttcctacacattttcataaagcaaaataattgtattatttaagcacagaaaaaaatgtatcttacatccaaagtagggagggcatccaacatattatagatttgcttttatatattttatagctttgtattgcatagtttgtctttaagagttcaagttagacttaaatataattttgatgttcactggttttattttaaattgccttcttatttgttagcaaaatgcctttttttaatggtctctgtaaattttctgggctttaatgtaatgccactgtgtaaaaaaaaaggaagaaaatagtaatagccatttaatgttttatatttatcattttaaagatatttttgtcaaatttcttttaataataataaacatatgtaatc

SEQ ID NO: 2966 - DNA, 11262 bp, Homo sapiens
ttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcagggaataaaaagagctacagagacttctgaagtggagagtctgcgacctcctcggttcttcaatgaagatggagttatcagaccgtacaggttgagggatgggactggaaatcaaatgttacaggtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaa

SEQ ID NO: 2967 - DNA, 2020 bp, Homo sapiens
gctccctggctggccggtttgagcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatactgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaggaagatgcaaaggcagcatgaacttagtgagagctgtagtgcaagtgcccttcaggcaagattgaaagtagctgcacatgaagctgaggaagaatctgataatattgcagaagatttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttctttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctaca

SEQ ID NO: 2968 - DNA, 4259 bp, Homo sapiens
actggacaaccgcagtctgcaagaggctgagctgaggagtcgctgggccgggaggggcggacgtgagaaggacggattgacgaactgatggattgacgcgcgggcggtaggagggaggaccgacgccaaacccagaccgccgccgtcgtgctcctgccgcagcccggagccggcagcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaaggcctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgaagtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttggattttgggatcttcgagtaccaagttgtgctcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattatggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgacgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaaaagaaaaaaaaaaaaaaaa

SEQ ID NO: 2969 - DNA, 3785 bp, Homo sapiens
ctgggcagtgcttctgggccctctgctgctcctgcttgtcggttgctaggcgctgggacgcgcctcccgaagggtgcggggcacaggtggcctcttcggggtggaccgcgcctggccggggccgaggacaccgcggccgcccgggcctgcgggaagcgatggagcccgggaagagaagaaccaaagatgatacctggaaagcagatgacctcagaaaacatctctgggccatacagtcaggtggttccaaggaagaaagaaagcacagagagaagaagctgcgtaaggagtctgagatggaccttcctgaacataaggagccgaggtgcagggatcccgaccaggatgccaggagcagagacagggtggccgaagtccacaccgctaaggagagtcctcgtggggagagggacagagacagacagagggagaggagaagagacgcaaaagaccgggagaaagaaaagctgaaggagaaacatcgagaggcagaaaagtctcacagcagaggaaaggacagggaaaaagaaaaagacagaagggcccggaaggaagagctccggcagaccgtggcccaccacaacctgctgggccaggagacacgcgaccggcagctcctggagcgggcggagaggaaaggccgctcagtaagtaaagtaagaagtgaagagaaagatgaagactctgaaagaggagatgaagatagagaaagaagataccgagaaagaaagctgcagtacggagacagcaaggacaaccctctcaagtactggctttataaagaagaaggcgagaggagacacaggaagcccagagagccagatcgagacaagaaacaccgagaaaaaagcagcacaagggaaaaaagagagaaatattccaaagagaaaagtaattcattctctgacaaaggggaagaaagacataaagaaaagcgacacaaagaaggttttcattttgatgatgagaggcaccaaagcaacgtggatagaaaagagaaatcggcaaaagatgagcccaggaaaagggaattccagaatggtgaacacagaaatcgaggtgcaagctcaaaaagagatgggaccagcagccagcatgctgagaatttagtaaggaatcatggaaaagataaagattcaagacggaagcatggccacgaggaaggctcttctgtgtggtggaagctggaccagaggccgggaggcgaggaaaccgtggaaattgaaaaggaagaaactgatttagaaaatgctagagctgatgcatatacagccagttgtgaagatgattttgaagactatgaagatgactttgaggtttgtgatggtgatgatgatgaaagcagtaatgaacctgagtcaagagaaaaactggaagaacttcctctagctcaaaaaaaggaaatacaagaaattcaaagagctattaatgcagaaaatgaaaggattggcgagttatctttgaaactgtttcagaagcgaggtagaacagaatttgaaaaggagcccaggacagatacaaacagttccccttccagagcctctgtttgtggaatttttgtggattttgcctcagcttcacaccgtcaaaagagtcggactcaggcccttaagcaaaagatgcgaagtacaaaactgcttcggctcattgacttagatttttcatttactttctctctcttggatctaccaccagtaaatgaatatgacatgtatatcagaaactttgggaaaaaaaataccaagcaggcatatgttcagtgtaacgaagataatgttgaaagagacattcaaacggaggaaatagagaccagggaagtgtggacccagcacccgggagaaagtactgttgtatctggaggcagtgaacaaagagatacctctgatgctgtagttatgccaaagattgatactccaaggttatgtagctttctgcgggctgcttgtcaggtgatggccgttttgctggaagaggatcgcttggcagctgaacccagctggaatcttagggctcaagacagggccctgtattttagtgacagctcatctcagctgaacaccagtctaccattccttcaaaatcgaaaagtatcctccttgcacacctcccgagttcagaggcagatggtggtctccgttcacgacttacccgagaagagctttgtgcccctgctggacagcaaatacgtcctctgtgtgtgggatatttggcagccttcagggccacagaaggttctgatatgtgagtcccaggtcacgtgttgctgcttgagccctttgaaagcatttttactgtttgccggaacagcgcacggctcagttgtcgtctgggatttgagagaagactcaaggctgcattactctgtgacgctgagcgatggcttctggacgttccggaccgccacgttttccaccgatggaatccttacctcagtaaaccaccgaagccctcttcaagcagtagaacctatctcaacgtccgtccacaaaaagcagagctttgtgctttcacccttttctactcaagaagaaatgtcaggtttgtccttccacatcgcttccttggatgagagtggggttctcaatgtatgggtggttgttgaattaccaaaggcagacatcgcaggttcaataagtgatttaggtctgatgcctggagggagggtcaagctggtacatagtgctctgatccagttgggtgacagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggtggataattctacatttgtgtgcaagtatatttatgtatatagactatgtatattctgtatataatttattttacatgaatatttctttggtattcccagtaaatacatgactacttttgagtggaaacaaagaacattctagcatttacaaaacttccaggggaatgtagagccacgtccagggtgctcttttctgagagtatttcgagttatttttagaacagtttaaatattgtcacattactgctagattttaaacagcctaccatgaaaatgtatcttaatgaactattttcttatgcataaagtatgtgaacacacgtctaaattaaaaggaattactccaccgcaaaaaaaaaaaaaaaaaa

SEQ ID NO: 2970 - DNA, 2288 bp, Homo sapiens
ggggctgcagctccgtcagcccggcagagccaccctgagctcggtgagagcaaagccagagcccccagtcctttgctcgccggcttgctatctctctcgatcactccctcccttcctccctcccttcctcccggcggccgcggcggcgctggggaagcggtgaagaggagtggcccggccctggaagaatgcggctctgacaaggggacagaacccagcgcagtctccccacggtttaagcagcactagtgaagcccaggcaacccaaccgtgcctgtctcggaccccgcacccaaaccactggaggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgcctgccgcaccacagcgccatcctcaagcgcggtttccgagaaagtgctttttccttctccatgctggctgctggggtcatgcacgcagtagccacggcctgcagcctgggcaagctggtgagctgtggctgtggctggaagggcagtggtgagcaggatcggctgagggccaaactgctgcagctgcaggcactgtcccgaggcaagagtttcccccactctctgcccagccctggccctggctcaagccccagccctggcccccaggacacatgggaatggggtggctgtaaccatgacatggactttggagagaagttctctcgggatttcttggattccagggaagctccccgggacatccaggcacgaatgcgaatccacaacaacagggtggggcgccaggtggtaactgaaaacctgaagcggaaatgcaagtgtcatggcacatcaggcagctgccagttcaagacatgctggagggcggccccagagttccgggcagtgggggcggcgttgagggagcggctgggccgggccatcttcattgatacccacaaccgcaattctggagccttccagccccgtctgcgtccccgtcgcctctcaggagagctggtctactttgagaagtctcctgacttctgtgagcgagaccccactatgggctccccagggacaaggggccgggcctgcaacaagaccagccgcctgttggatggctgtggcagcctgtgctgtggccgtgggcacaacgtgctccggcagacacgagttgagcgctgccattgccgcttccactggtgctgctatgtgctgtgtgatgagtgcaaggttacagagtgggtgaatgtgtgtaagtgagggtcagccttaccttggggctggggaagaggactgtgtgagaggggcgccttttcagccctttgctctgatttccttccaaggtcactcttggtccctggaagcttaaagtatctacctggaaacagctttaggggtggtgggggtcaggtggactctgggatgtgtagccttctccccaacaattggagggtcttgaggggaagctgccacccctcttctgctccttagacacctgaatggactaagatgaaatgcactgtattgctcctcccacttctcaactccagagcccctttaaccctgattcatactccttttggctggggagtccctatagtttcaccactcctctcccttgagggataaccccaggcactgtttggagccataagatctgtatctagaaagagatcacccactcctatgtactatccccaaactcctttactgcagcctgggctccctcttgtgggataatgggagacagtggtagagaggtttttcttgggaaagagacagagtgctgaggggcactctcccctgaatcctcagagagttgtctgtccaggcccttagggaagttgtctccttccattcagatgttaatggggaccctccaaaggaaggggttttcccatgactcttggagcctctttttccttcttcagcaggaagggtgggaagggataatttatcatactgagacttgttcttggttcctgtttgaaactaaaataaattaagttactggaaaaaaaaaaaaaaaaaa

SEQ ID NO: 2971 - DNA, 3186 bp, Homo sapiens
ggaactggcagcggggaggaggctctagcgaggcctgaaaggctgcgtaaccaggcaggagtaggggttggggttcggggttgggggacagccagggatcgcgtctgatatgctgttggggtcgtgaccgtctgggggccgaggcaggcactggccagacccagccagggatcctcgtattcgtcgagcctaatttccagcagccgggtaggcctcaccagaggctcctttccgtgaggccgcccccaattcctgcccctattctctgcctgggagatggcttccccgagccccccgccggagtcgaaggggttgctgacatttgaggatgtggctgtgttttttacccaggaggagtgggattatctggacccagctcagagaagcctgtataaagatgtcatgatggagaattatggaaacctggtctcactggatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaaaagcttcagccggagctcatttcttattgaacatcagagaatccacactggtgagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagaagatccatgcagaggtgaaaacccaagaaacccatgaatgtgacgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatgggtcagatttagtgataaagcaaattctccttggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttagctttgaaaaaaaaaaaaaaaaaa

SEQ ID NO: 2972 - DNA, 3280 bp, Homo sapiens
ggaactggcagcggggaggaggctctagcgaggcctgaaaggctgcgtaaccaggcaggagtaggggttggggttcggggttgggggacagccagggatcgcgtctgatatgctgttggggtcgtgaccgtctgggggccgaggcaggcactggccagacccagccagggatcctcgtattcgtcgagcctaatttccagcagccgggtaggcctcaccagaggctcctttccgtgaggccgcccccaattcctgcccctattctctgcctgggagatggcttccccgagccccccgccggagtcgaagagagacttgataaatcggcctgagaaaataagtaatgctccagactagctctctcatttgtgagttctccaggtgaagcaccatttttgaccttcccttgtgtcttctgttcctggcacagtgcctggaccccaaggaggagtgggattatctggacccagctcagagaagcctgtataaagatgtcatgatggagaattatggaaacctggtctcactggatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaaaagcttcagccggagctcatttcttattgaacatcagagaatccacactggtgagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagaagatccatgcagaggtgaaaacccaagaaacccatgaatgtgacgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatgggtcagatttagtgataaagcaaattctccttggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttagctttgaaaaaaaaaaaaaaaaaa

SEQ ID NO: 2973 - DNA, 1919 bp, Homo sapiens
atcaaaatgtgacagaagagacacgctgcatggctcggaacgcatctccttggtggtgggggaaagagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgacggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactgggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggaaaagccacataaatgcaaccagtgcggcaaagcgttcaaccgcagctccacgctcaacacgcatatccgcatccacgcgggctacaagcccttcgtctgcgaattttgcggcaaaggctttcaccaaaaagggaactacaagaaccacaagctgacccacagcggcgagaagcagtacaaatgtaccatctgcaacaaggccttccaccaggtctacaacctaaccttccatatgcacacccacaacgacaagaagcctttcacgtgcgccacttgcggcaaagggttttgcagaaactttgacttaaagaaacatgtgcgcaaactccacgacagcgtgggccctgctgccccctccgcaaaggacctgactaggacagtgcagagctgagagctactgccttgcccttccttccctccctgtaccacctgaaaacagatcacacatataaacttatttctaaaattaaaagaaaaaaaaactatagcagagaggctaaaatctatttatcgaaaccagcatatttttggaaagctaaatgtttcctcgatgactggcagcaaactcgtggcccccacctttgtatattcaggaaacttatttaaatccagtgcgccgaaacgtatttaattccaggcctccgcttctcctggggcagccagttttaaccccagcctgtcaccgtgagcgccccagaagagcgcggcgcccctagccatctttatacagccatgtaaatcctcctgtacaagcgaacacggaatatatacatatataactcaataaacaaaaaaaaaaaaaaa

SEQ ID NO: 2974 - DNA, 2001 bp, Homo sapiens
ggggcacttcagccagagcgcggggttaggggttcattgccttgtgtcctctgctccgggagacttcggtgattctgccactcactccgtcgctctgtgacctgctggcattgaatgatttatagctaagactccaggacacccctgaagccgagaaatggaactcttaacattcagggatgtggccatagaattctctccagaagagtggaaatgcctagaccctgcccaacagaatttatatagagatgtgatgttggagaactacagaaacctcgtctccctggctgtgtattcttattacaaccaaggcattttaccagagcaaggcatacaagattcattcaaaaaagcaacactgggaagatatgggagctgtggccttgaaaatatatgcttatggaaaaactgggaaagtataggtgaaggtgaaggacaaaaggaatgttataatctatgtagccaatatttgacaactagtcataacaaacatttaactgtgaaaggagacaaagaatatagaatatttcagaagaagcctcagtttctgtcagctgctcctacagaaccatgtattcctatgaataaatatcaacataaatttttgaaatctgtcttttgtaataaaaatcagataaattttaaccatgactcagatattagtaaacatcatagtactcattttctagaaaactattacaattgtaatgaatgtgaaaaagtattttaccaatcctcaaagcttattttccctgaaaatatccatattcaagaaaagccttacaactctaatgaatgtggtgaaacttctgacccattctcaaagcttactcaacatcaaagaatttatattggagagagctcacaaagatgtaataaaaaatgtataatagtctttagtcaatcacatctaaagggacataagataattaacactggagaaaaatcagtgaaatataaagaacgtggcaaagcttttaccaggggcttacatcttggacatcagaaaattcatactggagagaaaccttacaaatgtaaaaaatgtgacaaagcctttaacaagagttcacaccttgctcaacatcagagaatccatactggagagaagcctttcaagtgtaaggaatgtggcaaagcttttaacagaggctcataccttactcaacatcagagaatccatactggagagagagctttcaaatgtgaagaatgtggcaaagcctttaacagggggtcataccttactcaacaccagagaatccataccggagagaaacctttcagatgtaaggaatgtggcaaagcctttaatagaagctcatacgttactcagcatcagagaatgcatactggagagaaacctttcaagtgtaaggaatgtggcaaagcttttaacagagcttcacaccttactcaacatcagagaatccatactggagagaaacacttcaaatgtaaagaatgtggcaaagcctttaacaggggctcacaccttactcgacatcaaagaatccatactggagagaagtctttcaaatgtgaagaatgtggcaaagcttttatctggggctcacaccttactcaacatcagagagtccatactggagagaaattcttcaaatgtaaagaatgtggcaaagcttttaccaggagctcacaccttactcaacatcagagaattcatactggagagaaacctttcaaatgtaaagaatgtggcaaagcttttaacagacgctcaacccttactcaacatcaaataattcataccaggtagaaaccctgcaagtgtaaagaatgtgctaaaaccctaaactggtgctcacaccttactcaacattagaaaatcaatactggatagaaatcccatatgtgtaatgatttttgaaacatcaaaatgaagattaaataaaaattagaagtgtcactttagaaagaactaaggtgctagcacttccgtaaattactccaaaaaaaaaaaaaaaaaaaaaaaaaaaa

SEQ ID NO: 2975 - DNA, 3787 bp, Homo sapiens
aaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaataggaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaagtttgggaagttgatgaacaggtcaagaagcaacaggaaacacttgtgaggaaagtcacatccatctccaagaaaattctgataaaggaaaaagtcattgaatgtaaaaaagttgcgaaaatatttcctctgagttcagacattgttacttcaagacaaagcttctatgactgtgactcacttgataagggtttggaacataatttagacttacttagatatgagaaaggctgtgtaagagagaaacagagtaatgagtttgggaaaccattttaccattgtgcatcctatgttgtaaccccctttaagtgtaatcagtgtggacaagacttcagtcataaatttgacctcattagacatgagcgaattcatgctggagagaaaccttacgaatgtaaagaatgtggaaaagccttcagtaggaaggaaaatcttattacacatcagaaaattcatactggggaaaaaccgtataagtgtaatgaatgtggaaaagctttcattcagatgtcaaaccttattagacaccacagaattcatactggggagaaaccttatgcatgtaaggattgttggaaagccttcagtcagaaatcaaatctcattgaacatgagcgaattcacactggagagaaaccctatgaatgtaaggaatgtgggaaatccttcagccagaagcaaaatcttattgagcacgagaaaattcatactggggagaaaccttatgcatgtaatgaatgtggtagagctttttctcgaatgtcatctgttacgctacatatgagaagtcacacaggggagaaaccctataaatgtaataaatgtggaaaagctttctctcaatgctcagtatttattatacatatgagaagtcacactggtgagaaaccctatgtatgtagtgaatgtgggaaagccttctctcagagttcatccctaaccgtacatgcgaaatcatacagctgagaaaccctatgaatgtaaggaatgtggaaaagccttcagcaggaaagaaaatctcattacacatcagaaaattcacactggagagaaaccttatgaatgcagtgaatgtgggaaagcttttattcagatgtcaaacctcattcgacaccagagaattcatacgggtgagaaaccctatgcatgtacagtatgtggaaaagcctttagtcagaaatcaaacctcactgaacatgagaaaattcatactggagagaaaccttatcattgtaatcaatgtgggaaagctttcagtcagagacaaaatcttcttgagcatgaaaaaattcatactggagagaaaccattcaaatgtaatgaatgtggtaaagccttctctcgaatctcatccctcactcttcatgtgagaagtcacacaggggagaaaccctatgaatgtaataaatgtgggaaagccttttctcagtgctcattacttattatacatatgagaagtcatactggtgagaaaccctttgaatgtaatgaatgtgggaaagcattctctcaaagagcatccctttctatacataagagaggtcatacaggtgagagacaccaagtatattaaatgaaagaaggcctcttaaattcaacccatgttttacttaaaatatcttggcataagctcaaaaaagccaggatctttatggaaaaattttaatactttgttaaaaggtgtaagactggaataaatggaaagaaataccatatacatagatggaaaaacccagtattataaaaacctcaattctgaaaatctatagactgaatgcagttccaaacaaaatcaactaagaattttctaggatctttcaaaaatgattataaaattcatgtgaaatagaagtgtatgaattgctgcgacaattttgaaaagaatagaggaaacaccctcactgtatgatataaagttatagtcatttaaaaatgtgtgatattagtacattagtaggtaaatgagcagattttaaagaatagaatatccagaagcagattcatgaatatatgtgaactcagtgtatgttagacctgacatcatgaattagtagggaaatgatgacctagtcaataaaattgctgggaatatttgactctccgtattggagaaaataaaattacaacattacgacatactaaaaaatcaatattcttttttttttttttttttttttgagacaagcgtctcactctgtcgcccaggctggagtacggtggtgcaatctcagctcactgcagcctctgctttccgggtttttttgttttgttttgttttgttttttgtatttttagtagagacggggtttcaccatgttggccagggtagtcttgaactcctgacttcaaaagtgatcgccctctttggcctcccaaagtgctggggtttacaggcttgagccactgcacctggccaaaaaattaacattctaaaggatttaaatactggaatttgaaaagccaaactgtgaaaccattgggagaaaatagatgatattgtctatgacgttgaggccaaggagctttttttttttttttcaagacaaaaggactctgtaattccacttctaggtatatatacatcctatagaaactcacaaataatgcataagaaatatatatataatatatgtatgtatgtatagccagatgcagtggcacatgcctgtaatcccagctacttgggaggctgatagaagaagataacttgaggtcaggagttcaagaccagcctgggaaacatagcaagaccccatctcttaaaaaaaaagaaatatatagacatatatctgcattgaaaacaacctaaatattcatcagtggggtaatggatgaataaaatatgatatattcaaatgatagaatagtatacagcacttaaaagcagtgaaccagatccatattgtgtaacatggatagttaaaacaatgttgaatgaaaaaaatcaaaatacaaatgaaacattgtgtaataatatttatgtaaattggaatgaaatcatttataaagaacaactgtttctattattgaaaattgtatgtaaaactatttaaaatagaatagaaggatacacacccaattattgatagcattgtctctggagattgaatttgaggctgttgattaaaaggagactttagctttgcttgtagtttttataccttaaaaagactggtagcatataaaataaatcttaaaagctaattatacacaatgacaatatgaaaaaaaaaaaaaaaaaaa

SEQ ID NO: 2976 - DNA, 2864 bp, Homo sapiens
acacatccgcgcagaccaggaagcggatcccgtggattgaaggtcgcaccgcggcggattgacttctaaagacttggtacgtgaggaaaaaacacggaagaggaagaggaaagcaaaggagtcagggatggctcttcctcagggtctactgacattcagggatgtggccatagaattctctcaggaggagtggaaatgcctggaccctgctcagaggactctatacagagacgtgatgctggagaattataggaacctggtctccctggatacctcttccaaatgcatgatgaagatgttctcatcaacaggacaaggcaatacagaagtggtccacacagggacattgcaaatacatgcaagtcatcacattggagatacttgcttccaggaaattgagaaagatattcatgactttgtgtttcagtggcaagaaaatgaaacaaatggccatgaagcactcatgacaaaaatcaaaaagttgatgagtagtacagagcgacatgatcaaaggcatgctggaaacaaacctattaaaaatgagcttggatcaagctttcattcgcatctgcctgaagtgcacatatttcaccccgaagggaaaattggtaatcaagttgagaaggccatcaacgatgctttctcagtttcagcatcccaacgaatttcctgtaggccaaaaactcgtatttctaataagtataggaataatttcctccagtcttcattactcacacaaaaacgggaagtacacacaagagaaaaatctttccaacgtaatgagagtggcaaagcctttaatggtagctcactcttaaaaaaacatcagataatccatttaggagacaaacagtataaatgtgatgtatgcggcaaggactttcatcagaagcgataccttgcatgccatagatgtcacactggtgagaatccttacaagtgtaatgagtgtggcaagacattcagtcacaattcagccctgttagttcacaaggcaattcatactggagagaaaccttacaagtgtaatgaatgtggcaaggtttttaatcaacaatcaaaccttgcacgtcatcatagagttcatactggagagaaaccttacaaatgtgaagaatgtgacaaagttttcagtcgcaaatcacaccttgaaagacataggagaattcacactggagagaaaccatacaaatgtaaggtttgtgacaaggctttcagacgtgattcacacctggcacaacatactgtaattcacactggagagaaaccttacaagtgtaatgagtgtggcaagacctttgttcaaaattcatctcttgtaatgcataaggtcattcatactggagagaaacgttacaagtgtaatgaatgtggcaaggtttttaatcacaaatcaaaccttgcatgtcatcatagacttcatactggagagaaaccttacaagtgtaatgaatgtggcaaggtttttaatcgaaaatcaaaccttgaacgtcatcatagacttcatactggaaagaaatcttagaagtgtaaatttgcaaggtttttaggcaacagtcaaaccttgcatgtcatcatagactttatactggagagaaaccttacaaatgtgaagaatgtgacaaaagttttcaatttcaaatcactccttgaaatacataggagagttcatactggagagaaaccatacaaatgtaaggtttgtgacaaggatttcgggtgtgattcacacctggcccaacatactggaattcacactggaaaggaactgtacaagtgtaatgagtgtggcagagcctttggtggtcagtcaacacttactcaccatcaagcaatccatggtatagggaaacttgactaatgtaatgattgtcacaaagtcttcagtaatattacagccattgcaaaacattggagaatccataatgaaggaggtcttacaagtgtaataaatgtggcaagtttttcagacatcattcataacttgcagttcattggcgatcttatacaggagagaaatcttacaaatgtgatgattgtggcaaggtcttcagtcaagcttcatcttttgcaaaacgggagaattcatacaggagagaaacctcacaagtgtgatgattgtgagcaaagcctttacttcacgttcacaccacattagatatcagaggatccatactggacagaaatcttacaaacgtcctatgtgtggcaaggtcttcagtccgaggttactccttgcagaatatcataacgttcatttttgaggtaatagttacaaatgcggtgagcacagcaaaccatcaaggattgacagtagagtcaattcagaattgacttgagtttgagttgacttaaaacattcagttgaagcattaattgacattaaagtgtttatgttaagaggattgggccaggcgtgtggctcacgcctgtaaacccagcactttaggagcccaaggtggatagatcacttgaggtcatgagtttgagatcagcctggccaacagacgtgagtcacttttcccagcctgctttttgtttctttaacaaaaaccaataggggtttttataggtattgtgttgaatctgaatcacattggcttatataataacaatattgatttttccaaaccatcaatgtgggttgtatatatatgtttttaatcattttggttaatgtttgtagatttcaaggtgtgaaattctcagtttttttatgtttattcctaagtatttcttactttaagatctctagcaaatggaagtgttttttaattttcgtttaaattttttattgtttatggaaattcaattaatttttggtgctgctattgcattgtgcaaatccactgaatgtgttgatt

SEQ ID NO: 2977 - DNA, 3745 bp, Homo sapiens
ggaagcggctgcggttctcgccggttctcagccggggtttgatagttgtcaggaggattcgacgttcagtgcccagggatgtggagagtctcactctgtcacccaggctggagtgcagtttgtgtgatctcaactcactgcaacctctgcctcctgggttcaagcgattctcctgcctcagcctcccgagtagctggaattacagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgaggtatcagtgtcatttgaggatgtgactgtggacttcagtagagaggagtggcagcaactggactctactcaaagacgcctgtaccaggatgtaatgttggagaactacagccacctgctctcagtggggttcgaagttcctaaaccagaggtcatcttcaagttggagcaaggagaggggccatggacattggaaggggaagccccacatcagagctgttcagatgggaaatttggaattaagccttcccagaggagaatttctgggaaatctacatttcatagtgaaatggagggtgaagacacactgtgttaggtagaaaaatgctacagatgtcttcatccctgtatatgtgtccttcttcagtctttatttctctttgtgtttcagttaggataatttctattgatctgtcttcaaattcactgatgttttttctctcaccctggctttgtcaagtctactgctgaacccattgaaggcattcttcaactcagttatgttttatttttatttgtaatatttccatttgattcttacaattttcatatatctgctgaaattccccatcttttcatgcatgttcatgttttcccctttaccctttgtcttagtcagtttgagctgctataataaagcaccatagacttggtggcttataaacaacagaaatttattcctcacagttctggagcctggaagtctgagatcagaatctagcaaggttaggtcttggtgacggccctcttcaaggttgcaaactgctcacttcttgcattttcccatgtctacagctagagaactctttgggatcccttttataagggcaccaatcccattcatgagttctccacccacattacctaactaccacccaaaggctccacctcctaataccatcacattgaggattaggattttaacatatgaattttgggggggatgcaatcattcagcccataataccctctaacatattaatcatagttatttttaactccctgtctgatagttccaactactaggtcaactgagtctaggtctgttgttgtcttctcttgctcttttgcatctaataatttttggctgaatgtcacagatgttgtatgtaggacagtagaaactgaggtaaatagtaattattcctggaaacagccatggttgcccttttgataggccattagcatggggagattgaatccatctaatcaggagttgggctgagtttgtgtttctttgttgccagtgttacctttgctgtaccatagacttaaaattcctctattgttatcttatgcttgaggtaggcactggtttgcccagagaatttttatttttcccagaccacacttgcctttaggcctgtaggcctttcctgtgtgcctgcatctcagggagggtctctctccatgttgttgcctctatgttagtagtagacaactgttattacttggttcttgctgacctggtgagttggggggcaggggttgtcttgggccagcctcagtttttgtcaggccatgaatccctgggtcttgagggtgggattttttagtgatcctgccctcttccactggtagaaggcctctaatgatctgggcccaggatgatttcctgcccttttatcatgggtggaatttttttttccatttccctcactctagtcacagtgaatctttaactgtgtcctgagggcaacagggtttgctgcacttcttttagtggcttaaggattttgttctgtaggggagtagggtttcattggagctttgtgccatttctatgttaacagcagcccccttgcaggcctaccccatggaggtaggctttctccagtcttcttccttgtccccgtgtttcttgagagcactcagtggatgactatggagaagagcctgcaagcagagaccaactacccttaggtctacagctctcatgagtctcccgcactcagcctttagcaattcattaaaaattcttgttgaattcttactgcttgtatagtggcctcatcttccttcctgctgtaccacagatggcccaggagaggcacttgtcttttattatatttcaagctagttggttgctctgtaatcttagctctctgatgggttcgagaaaacttatgtttttgcagattacccagctttgttcttgttataaagatgggagcagtgttctttccagatgtctacatgctaggcagaaactagaagtctggacagtctccatggtctcctactatcagaatatgtgcccttttcagtgtgactttgccacttcacccatcaagaggtagaatctatttcttcaacccctgcaactgagcttggctattttgttggccaatgggacattaacaagtatgatacaagcagaggcttgagaagtgcctgcacaatgaggcttgcccacttttgcagctctttggaatcctgaacccatgtgtggaaaagcctgaactgtgctgttggaaaatgagagcgatcacatggagcagtaatggagcaaagaccagccatcccagttgagataccctacaccaaccagattttcaactgctggacatatgaatgaagctatcctaggcatgcagtcttggtcaaggcaactttggctggcagtctctgagatgaccctgaatgatccccacctcctggtattctcactcttatataatcccctcctcttgagtttggactggaattagtgacttggttctagtgaatagaatgaggcagaggtaatgggatgtcatgttcaagattggttacaaaaagactgtggcttccattttgggtgcttgcttactctctcagatggctcatcataggggaaacctgctgctacatcatgagatagccctgtggaaaggtccacatgagtgaactttgaagcatatcctcccccagtttagcctttagatgaggaccacagccaaatagcttgactgtaagccagatagcttgactcatgagggaccttcagccagaggcatcttttgagccatacgaattcctgacccatagaaactgcaagacaataaatgttgttttaagttgctaaattttagggtaatttgttacacagtaataggttaataatacactggcccagattaggaaggttctgccatccatcccagccatcccaaacaactaccagaataatggattaaaacgttaactgttttaagtcactaagttttgggcagcatgataacaacccagcaaaaagctaactgatacattgattatttattgcatttcttcctccactattcttctctaacagatgaccaatactaataaactactgtgaac

SEQ ID NO: 2978 - DNA, 6334 bp, Homo sapiens
atgacatacattcatatgaaacatagttattgtattagtcagggttttccagagaagatctacaaggaaggggctctgaagcagggccaagcagtaggggaagcagccttgatgcttgggctgtataagccagcaggcccagttgaaggttctacaggactaaaggttcgaatccattgcaccctaacttacggctgctgccagggcatcagagactccttgtgcccaggggctagcaggaagagaactgtggaagatctgctccctgatttgcatgaagaagtaaattgtccattcctgtctggccggcggcaggtgggttggaggtgcgcgggcgggcgggcgggcgtgcgagagcgtccggcgctcctctcccctccgcggtcgccggatccgcgagagcgctcggctcgcgttctaggctgtttgcgcctggagcgcgccgcgggcccgcgctcgctcccgcctgtcttcgcgtccgcggcggccaggacaccgcgcgccgcctcacgctaccctgcaggccgcccgcgtctgccctcgcggcgcgctcccgggcccggccgcggttccccactcgggccggctggctcgcgggttctctcgccccgcccccctcggcgccaccgctgggcgcttgcgcggggcgcgtggccgtggccagggtctccgccgcagcccgagcagccgccgccgcctcagtcagtcagtcagtccccagcaatggcggacggaggtgagcgagaggagctgctctcgccgtcaccggtctctccggctaagcggcagtgttcgtggcccagcccgcaggctcatcaccctcgcggttcgcctggggcagccggcggaggggcagggggcgtcggcagcagctgcctggtcctcggggcccgcccccacctgcagccggattccttactggactgcgccgccaagacggtggcggaaaagtgggcatacgaacgggtggaggagcgcttcgagcggatcccggagcccgtgcagcgccgcatcgtctactggtccttcccgcggaatgagcgggagatctgcatgtactccagcttccagtaccggggcggccccggcgccggcgctgctggcggcgccgcgggggcttcgccggccgaggaggggccgcagccaccccccggggccgccgctccggccggctccgcccccgggggcgtcgcggctggggcatcccccgggctgggcgcaggggccggcgcggccggctgcggtggcgaggggctcccgttccgccggggcatccgtctgctggacagcggctccgtggagaacgtgctgcaagtcggctttcatctgagtggcacagtaactgagctggccactgcctctgaaccagcagtgacttataaagttgcaatcagttttgatcgatgcaaaatcacctcagtgacatgtggctgtgggaacaaggacatattctactgtgcccatgtggtagcactctcactctacaggatccgtaaaccagaccaagtcaaattgcgtcttcctatctccgaaacccttttccagatgaatagggaccagctacaaaagtttattcaatatttaatcacggcacaccacactgaagttcttcctactgcacagaaactggcagatgagattctatcctccaactcagaaatcaaccaagtgaatggtgcccctgaccccacagctggggccagcattgacgatgagaactgttggcatttggatgaagaacaggtgaaagaacaagtgaagctttttctctcccagggcggttactgtggctctggaaagcaactcaactcaatgtttgccaaggttcgagaaatgctgcggatgagagattccaatggagcaaggatgctgacactaataactgagcagtttgtggctgacccacgactcacactctggaggcagcaaggaacaaacatgacagacaagtgcaggcagctctgggatgagctaggggctttatgggtgtgcataattttaaatccacactgcaaactggaggagaaatcctgctggctgcagcagctgcagaagtggagcgacctggatgtctgtcccctggaggatggaaactatggacatgagctgcccaacatcaccaatgcacttccccagagtgccattcacagcccagactccttatccagaccaagacgaacagtattcactagagccattgaggggcgtgaattacattggcaggatagccacctacagcgaataatcagcagtgatgtttatacagctcctgcctgccagcgggaaagtgaaagactactctttaattcccaaggccagccactgtggcttgagcatgtgcctacagcctgtgctcgagttgacgccctgcgttcccatggttatccaaaagaggccctcagactcacagtggccattattaatactctgaggttgcagcagcagcggcaactggaaatctacaagcatcagaagaaagaactgttgcagagaggaaccacaaccatcacaaacctggagggctgggtgggccaccccctggatcccatcgactgcctgtttctcactttgactgaggcctgccgcctgaatgatgatggctatctggagatgtcagatatgaatgaaagcagaccccctgtgtaccagcatgtacctgtggctgcaggctccccaaacagcagtgagtcctacctgtcattggccctggaagttgcactgatgggcctgggtcaacagaggttaatgcctgaaggcctctacgcacaggacaaggtatgccgtaatgaggagcagctcctgagccaactccaagagctgcagctggacgatgagctagtgcaaacactgcaaaaacaatgcatcttactgctggaaggaggtcctttcagcggtctgggagaagtcatccaccgagagagtgttcccatgcatacctttgccaagtatttgttctcagctctgctgcctcatgatccagacctgtcctataaattagccttacgtgccatgaggttacctgttttagaaaactcagcttctgcaggcgacacatcccaccctcaccatatggtgtctgtggtgcccagccgttatcctcgctggttcacgcttggacacttggaatcacagcagtgtgaactggcctccaccatgctgactgctgccaaaggagacactttgagactccgaacaattctggaagcaatacagaagcacattcattcttcctccctcatcttcaaactggcccaagatgcattcaagattgctactcccaccgacagtagtactgacagcaccctgctcaacgttgccctggaacttgggttacaggtgatgcggatgaccttatcaacccttaactggagacgcagggagatggtacgatggttggtgacctgtgctacagaagtgggtgtgcgggccctggtgagcatcttgcagagctggtacacactcttcacccctactgaggctactagtattgtagctgccacagccgtatcccacaccactatcctgcgcctcagtcttgactatccacagcgggaggaactggctagctgtgctcgcacactggctctacagtgtgctatgaaggatccacagagctgtgccctgtcagcccttacactctgtgagaaagaccacattgcctttgaggcagcctaccagattgccattgatgctgctgctggtggtatgacccattcacagctgttcaccatcgcccgctacatggagctccgtggctacccgctacgtgccttcaagctggcctcattggccatgagccatcttaacctggcctacaaccaggatactcacccagccatcaatgatgtgctctgggcttgtgctctcagccactctctgggcaagaatgagctggcagctctcatccccctggtggtgaagagtgtgcactgtgccacagtgctttcagacatcttacgacgctgcacagtgactgcacctggcctggccggcatcccaggccgccgaagctctggaaagctcatgtccactgacaaagctccattgcgccagttgctggatgccaccatcaatgcctatatcaacactacacactcacgcctaacacacatcagccctcgccactatggagagttcattgagtttctaagcaaggctcgggagaccttcctgctgccccaggatggccacctgcagtttgcccagttcatcgacaacctcaaacagatctacaaaggcaagaaaaagttgatgctgctggtgcgagagcgctttggctgagagagcagatagctcactgccagagcagcctgggttcccaggtagtatcaggtcaggccaagggcactgaaacatttgtccaccctgagagaactctgagcacctgtggatgaggccaaaggaccacagggctaaggatggggaaagtccagctctagtcgataatgcctaccttggcaagcttctgactacagcctactgttcatggaggagctgggccctgcagatcgaccagaaaccccacaacatgccacctcatgcccctatatcctgcgtgtcctgagcattggccctgtctcccttggcaaacacagaacactgttccatctcagggattgcttaaccagagaaacagacacatttgtgggactgtaaatactatatgtgttgctaattattgtaaacttgtaactatttataattctgcttctgatttgatgggcacttgaagtagctgtgggtaggaggatatgcttattttctgaggagactcacaaccatttctcaggtttcccttgcagagtgtttgctggtagcagtggaagagtgggggtgccaaggagaaaaatggccagttaggatcaacccaagtctagtctatgcagaatcccccacctacagacagggcatttatagtccagtggtgagtgagggacagaggccaggactggacttagacttttgcctcacaaaactgtgaggacattgaagctcctgcctcacacagcctcttcaggagcctgctgaacacctgagaaacaagtgcagggagaagatgaaggtctgggaagccgctgagttcataatattcatctactgtggtcacctttgtgttagcaagtgtgtggtttcatctataattgtgtgtgtgtatctttatggctaagtacatgtgtgtatgtacatagatacatctgtgcatgcctgtttgtgcacatatatatttatgtgtatgtgtcagttctatggctgtgtacctgtttgaatatgtgcacactggactgtgagtttctacgtgaggatatacacattttgtgtacatgtgaggatgcacatctttgtgcaaatgcactcatgtttgtgcatgtttagtatgtgtatctgcgtacacgagtgcatgtgtataaacatgtttgtatccatgtgtatgcttgttatccatgcatctgtgtctttatatgtgtaactgagcgtatttctacatgtagggatgtctgtgtattcatgtttgaggatctgcatcaatgtgtcctttttgccagatttctctttcccattcctcttaaatctctctcgccagctaaacgtttgttccccatctctgtgcctcctctattcattctctcaccaaacaagcttctaagcaccaatctccctctgccatcagattggctgctttagctccatagttctcttctcgcctcatacttgctttcttcccctgcctttctacctcaagcttcctcgccggcttttgtcacagtctcattgctcgctgacttggaggctagggctggtctgcacttagcctctcccttcctaatttctagccctagtgggcagtcctgtcttagccctggctgacctccatagtgtatcatgttcctgctaccttcctgacccctgtgctcagcctggaattgttataggaggtagcaagggcactcagaaaagtcagttggaaccagtgtcttggtgtttactgtttcatgtcttagttcctgagttgggggtggggtttgatagggaaggggtggtatagctagaatgtgaactaagaacttctccatctgctttactttttctttcttcgacaaactgtcaccttttttactccaaactgaccaagaagttgtatttgccatttgtggctactcaagtcttactgtccagccaagggcccctacgtctcagcccaatgggttggttaaaaaaaagagagaagccactctcatttctgtatcacagttgcccttttttagcaagtgtgtgaattcacagtgcttttctatgaataaatcatggatcacataaaagatcatttttctaaaag

SEQ ID NO: 2979 - DNA, 6334 bp, Homo sapiens; identical to SEQ ID NO: 2978

SEQ ID NO: 2980 - protein, 968 aa, Homo sapiens
MDSTLTASEIRQRFIDFFKRNEHTYVHSSATIPLDDPTLLFANAGMNQFKPIFLNTIDPSHPMAKLSRAANTQKCIRAGGKQNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 2981 - protein, 475 aa, Homo sapiens
MAELQMLLEEEIPGGRRALFDRYTNLERVADYCENNYIQSADKQRALEETKAYTTQSLASVAYLINTLDNNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSLAPPPPSILQVTPTLPLMGFVARVQENISDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 2982 - protein, 1158 aa, Homo sapiens
MAAVRGAPLLSCLLALLALCPGGRPQTVLTDDEIEEFLEGFLSELEPEPREDDVEAPPPPEPTPRVRKAQAGGKPGKRPGTAAEVPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPEEETEQPTLDYNDQIEREDYEDFEYIRRQKQPRPPPSRRRRPERVWPEPPEEKAPAPAPEERIEPPVKPLLPPLPPDYGDGYVIPNYDDMDYYFGPPPPQKPDAERQTDEEKEELKKPKKEDSSPKEETDKWAVEKGKDHKEPRKGEELEEEWTPTEKVKCPPIGMESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMTFHGNVDKDTPVLSELPEPVVARFIRIYPLTWNGSLCMRLEVLGCSVAPVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 2983 - protein, 2817 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAVGLSTSSTAAELQHGMGNTSLTGLGGEHEGPAPPAIPEALNIKGNTDSSLQSVGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQPSPLDVGVKNTQSQGKTSACEVSGDVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVMRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSMSWCPSGVQYSAGLSADFNYRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 2984 - protein, 2813 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAVGLSTSSTAAELQHGMGNTSLTGLGGEHEGPAPPAIPEALNIKGNTDSSLQSVGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQPSPLDVGVKNTQSQGKTSACEVSGDVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVMRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 2985 - protein, 1058 aa, Homo sapiens
MSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 2986 - protein, 732 aa, Homo sapiens
MKVTVCFGRTGIVVPCKEGQLRVGELTQQALQRYLKTREKGPGYWVKIHHLEYTDGGILDPDDVLADVVEDKDKVLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSGSV

SEQ ID NO: 2987 - protein, 1144 aa, Homo sapiens
MKVTVCFGRTGIVVPCKEGQLRVGELTQQALQRYLKTREKGPGYWVKIHHLEYTDGGILDPDDVLADVVEDKDKVLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 2988 - protein, 1105 aa, Homo sapiens
MKVTVCFGRTGIVVPCKEGQLRVGELTQQALQRYLKTREKGPGYWVKIHHLEYTDGGILDPDDVLADVVEDKDKVLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERESGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 2989 - protein, 2542 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSSTSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQIWPGTWAPHIGNMHLKYVN

SEQ ID NO: 2990 - protein, 616 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLDKQEDMKTILEGIDPAKHQVRVAFDACKLLRKE

SEQ ID NO: 2991 - protein, 627 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLDKQEDMKTILEGIDPAKHQVRVAFDACKLLRKE

SEQ ID NO: 2992 - protein, 541 aa, Homo sapiens
MTGEKIRSLRRDHKPSKEEGDLLEPGDEEAAAALGGTFTRSRIGKGGKACHKIFSNHHHRLQLKAAPASSNPPGAPALPLHNSSVTANSQSPALLAGTNPVAVVADGGSCPAHYPVHECVFKGDVRRLSSLIRTHNIGQKDNHGNTPLHLAVMLGNKECAHLLLAHNAPVKVKNAQGWSPLAEAISYGDRQMITALLRKLKQQSRESVEEKRPRLLKALKELGDFYLELHWDFQSWVPLLSRILPSDACKIYKQGINIRLDTTLIDFTDMKCQRGDLSFIFNGDAAPSESFVVLDNEQKVYQRIHHEESEMETEEEVDILMSSDIYSATLSTKSISFTRAQTGWLFREDKTERVGNFLADFYLVNGLVLESRKRREHLSEEDILRNKAIMESLSKGGNIMEQNFEPIRRQSLSPPPQNTITWEEYISAENGKAPHLGRELVCKESKKTFKATIAMSQEFPLGIELLLNVLEVVAPFKHFNKLREFVQMKLPPGFPVKLDIPVFPTITATVTFQEFRYDEFDGSIFTIPDDYKEDPSRFPDL

SEQ ID NO: 2993 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 2994 - protein, 1312 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMSVECR

SEQ ID NO: 2995 - protein, 1226 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMSVECR

SEQ ID NO: 2996 - protein, 186 aa, Homo sapiens
MGLLDRLSVLLGLKKKEVHVLCLGLDNSGKTTIINKLKPSNAQSQNILPTIGFSIEKFKSSSLSFTVFDMSGQGRYRNLWEHYYKEGQAIIFVIDSSDRLRMVVAKEELDTLLNHPDIKHRRIPILFFANKMDLRDAVTSVKVSQLLCLENIKDKPWHICASDAIKGEGLQEGVDWLQDQIQTVKT

SEQ ID NO: 2997 - protein, 186 aa, Homo sapiens; identical to SEQ ID NO: 2996

SEQ ID NO: 2998 - protein, 948 aa, Homo sapiens
MVFLPLKWSLAIMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPPQEQIALLAPEPLLVGLPYTVVIHYAGNLSETFHGFYKSTYRTKEGELRILASTQFEPTAARMAFPCFDEPAFKASFSIKIRREPRHLAISNMPLVKSVTVAEGLIEDHFDVTVKMSTYLVAFIISDFESVSKITKSGVKVSVYAVPDKINQADYALDAAVTLLEFYEDYFSIPYPLPKQDLAAIPDFQSGAMENWGLTTYRESALLFDAEKSSASSKLGITVTVAHELAHQWFGNLVTMEWWNDLWLNEGFAKFMEFVSVSVTHPELKVGDYFFGKCFDAMEVDALNSSHPVSTPVENPAQIREMFDDVSYDKGACILNMLREYLSADAFKSGIVQYLQKHSYKNTKNEDLWDSMASICPTDGVKGMDGFCSRSQHSSSSSHWHQEGVDVKTMMNTWTLQRGFPLITITVRGRNVHMKQEHYMKGSDGAPDTGYLWHVPLTFITSKSNMVHRFLLKTKTDVLILPEEVEWIKFNVGMNGYYIVHYEDDGWDSLTGLLKGTHTAVSSNDRASLINNAFQLVSIGKLSIEKALDLSLYLKHETEIMPVFQGLNELIPMYKLMEKRDMNEVETQFKAFLIRLLRDLIDKQTWTDEGSVSEQMLRSELLLLACVHNYQPCVQRAEGYFRKWKESNGNLSLPVDVTLAVFAVGAQSTEGWDFLYSKYQFSLSSTEKSQIEFALCRTQNKEKLQWLLDESFKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLEHDPEADATG

SEQ ID NO: 2999 - protein, 1294 aa, Homo sapiens
MALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQLTTISLIIRCLEPDTIYMFTLWGVDNTGRRSRPSDVIVKTPCPVVDDVKAQEIADKIYNLFNGYTSGKEQQTAYNTLLDLGSPTLHRVLYHYNQHYESFGEFTWRCEDELGPRKAGLILSQLGDLSSWCNGLLQEPKISLRRSSLKYLGCRYSEIKPYGLDWAELSRDLRKTCEEQTLSIPYNDYGDSKEI

SEQ ID NO: 3000 - protein, 1216 aa, Homo sapiens
MALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQLTTISLIIRCLEPDTIYMFTLWGVDNTGRRSRPSDVIVKTPCPVVDDVKAQEIADKIYNLFNGYTSGKEQQTAYNTLLDLGSPTLHRVLYHYNQHYESFGEFTWRCEDELGPR

SEQ ID NO: 3001 - protein, 361 aa, Homo sapiens
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAVFSLAIKLQPSIIFIDEIDSFLRNRSSSDHEATAMMKAQFMSLWDGLDTDHSCQVIVMGATNRPQDLDSAIMRRMPTRFHINQPALKQREAILKLILKNENVDRHVDLLEVAQETDGFSGSDLKEMCRDAALLCVREYVNSTSEESHDEDEIRPVQQQDLHRAIEKMKKSKDAAFQNVLTHVCLD

SEQ ID NO: 3002 - protein, 1220 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQIRVVKAFRSSLYEGLEKPESKTSIHNFMATPEFLINDYTHNIPLIDDTDVDENEERLRAPPPPSPNQNNNAIDSGIYLTTHVTKSATSSVFSSSPGSPLHSVETSL

SEQ ID NO: 3003 - protein, 1173 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGNPGGESVP

SEQ ID NO: 3004 - protein, 511 aa, Homo sapiens
MALRAMRGIVNGAAPELPVPTGGPAVGAREQALAVSRNYLSQPRLTYKTVSGVNGPLVILDHVKFPRYAEIVHLTLPDGTKRSGQVLEVSGSKAVVQVFEGTSGIDAKKTSCEFTGDILRTPVSEDMLGRVFNGSGKPIDRGPVVLAEDFLDIMGQPINPQCRIYPEEMIQTGISAIDGMNSIARGQKIPIFSAAGLPHNEIAAQICRQAGLVKKSKDVVDYSEENFAIVFAAMGVNMETARFFKSDFEENGSMDNVCLFLNLANDPTIERIITPRLALTTAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHADVSNQLYACYAIGKDVQAMKAVVGEEALTSDDLLYLEFLQKFERNFIAQGPYENRTVFETLDIGWQLLRIFPKEMLKRIPQSTLSEFYPRDSAKH

SEQ ID NO: 3005 - protein, 1251 aa, Homo sapiens
MSTERDSETTFDEDSQPNDEVVPYSDDETEDELDDQGSAVEPEQNRVNREAEENREPFRKECTWQVKANDRKYHEQPHFMNTKFLCIKESKYANNAIKTYKYNAFTFIPMNLFEQFKRAANLYFLALLILQAVPQISTLAWYTTLVPLLVVLGVTAIKDLVDDVARHKMDKEINNRTCEVIKDGRFKVAKWKEIQVGDVIRLKKNDFVPADILLLSSSEPNSLCYVETAELDGETNLKFKMSLEITDQYLQREDTLATFDGFIECEEPNNRLDKFTGTLFWRNTSFPLDADKILLRGCVIRNTDFCHGLVIFAGADTKIMKNSGKTRFKRTKIDYLMNYMVYTIFVVLILLSAGLAIGHAYWEAQVGNSSWYLYDGEDDTPSYRGFLIFWGYIIVLNTMVPISLYVSVEVIRLGQSHFINWDLQMYYAEKDTPAKARTTTLNEQLGQIHYIFSDKTGTLTQNIMTFKKCCINGQIYGDHRDASQHNHNKIEQVDFSWNTYADGKLAFYDHYLIEQIQSGKEPEVRQFFFLLAVCHTVMVDRTDGQLNYQAASPDEGALVNAARNFGFAFLARTQNTITISELGTERTYNVLAILDFNSDRKRMSIIVRTPEGNIKLYCKGADTVIYERLHRMNPTKQETQDALDIFANETLRTLCLCYKEIEEKEFTEWNKKFMAASVASTNRDEALDKVYEEIEKDLILLGATAIEDKLQDGVPETISKLAKADIKIWVLTGDKKETAENIGFACELLTEDTTICYGEDINSLLHARMENQRNRGGVYAKFAPPVQESFFPPGGNRALIITGSWLNEILLEKKTKRNKILKLKFPRTEEERRMRTQSKRRLEAKKEQRQKNFVDLACECSAVICCRVTPKQKAMVVDLVKRYKKAITLAIGDGANDVNMIKTAHIGVGISGQEGMQAVMSSDYSFAQFRYLQRLLLVHGRWSYIRMCKFLRYFFYKNFAFTLVHFWYSFFNGYSAQTAYEDWFITLYNVLYTSLPVLLMGLLDQDVSDKLSLRFPGLYIVGQRDLLFNYKRFFVSLLHGVLTSMILFFIPLGAYLQTVGQDGEAPSDYQSFAVTIASALVITVNFQIGLDTSYWTFVNAFSIFGSIALYFGIMFDFHSAGIHVLFPSAFQFTGTASNALRQPYIWLTIILTVAVCLLPVVAIRFLSMTIWPSESDKIQKHRKRLKAEEQWQRRQQVFRRGVSTRRSAYAFSHQRGYADLISSGRSIRKKRSPLDAIVADGTAEYRRTGDS

SEQ ID NO: 3006 - protein, 475 aa, Homo sapiens
MAAPRPPPARLSGVMVPAPIQDLEALRALTALFKEQRNRETAPRTIFQRVLDILKKSSHAVELACRDPSQVENLASSLQLITECFRCLRNACIECSVNQNSIRNLDTIGVAVDLILLFRELRVEQESLLTAFRCGLQFLGNIASRNEDSQSIVWVHAFPELFLSCLNHPDKKIVAYSSMILFTSLNHERMKELEENLNIAIDVIDAYQKHPESEWPFLIITDLFLKSPELVQAMFPKLNNQERVTLLDLMIAKITSDEPLTKDDIPVFLRHAELIASTFVDQCKTVLKLASEEPPDDEEALATIRLLDVLCEMTVNTELLGYLQVFPGLLERVIDLLRVIHVAGKETTNIFSNCGCVRAEGDISNVANGFKSHLIRLIGNLCYKNKDNQDKVNELDGIPLILDNCNISDSNPFLTQWVIYAIRNLTEDNSQNQDLIAKMEEQGLADASLLKKVGFEVEKKGEKLILKSTRDTPKP

SEQ ID NO: 3007 - protein, 911 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 3008 - protein, 381 aa, Homo sapiens
MERGMHLGAAAAGEDDLFLHKSLSASTSKRLEAAFRSTPPGMDLSLAPPPRERPASSSSSPLGCFEPADPEGAGLLLPPPGGGGGGSAGSGGGGGGGVGVPGLLVGSAGVGGDPSLSSLPAGAALCLKYGESASRGSVAESSGGEQSPDDDSDGRCELVLRAGVADPRASPGAGGGGAKAAEGCSNAHLHGGASVPPGGLGGGGGGGSSSGSSGGGGGSGSGSGGSSSSSSSSSKKSKEQKALRLNINARERRRMHDLNDALDELRAVIPYAHSPSVRKLSKIATLLLAKNYILMQAQALEEMRRLVAYLNQGQAISAASLPSSAAAAAAAAALHPALGAYEQAAGYPFSAGLPPAASCPEKCALFNSVSSSLCKQCTEKP

SEQ ID NO: 3009 - protein, 323 aa, Homo sapiens
MPVHSRGDKKETNHHDEMEVDYAENEGSSSEDEDTESSSVSEDGDSSEMDDEDCERRRMECLDEMSNLEKQFTDLKDQLYKERLSQVDAKLQEVIAGKAPEYLEPLATLQENMQIRTKVAGIYRELCLESVKNKYECEIQASRQHCESEKLLLYDTVQSELEEKIRRLEEDRHSIDITSELWNDELQSRKKRKDPFSPDKKKPVVVSGPYIVYMLQDLDILEDWTTIRKAMATLGPHRVKTEPPVKLEKHLHSARSEEGRLYYDGEWYIRGQTICIDKKDECPTSAVITTINHDEVWFKRPDGSKSKLYISQLQKGKYSIKHS

SEQ ID NO: 3010 - protein, 385 aa, Homo sapiens
MSGDSSGRGPEGRGRGRDPHRDRTRSRSRSRSPLSPRSRRGSARERREAPERPSLEDTEPSDSGDEMMDPASLEAEADQGLCRQIRHQYRALINSVQQNREDILNAGDKLTEVLEEANTLFNEVSRAREAVLDAHFLVLASDLGIEKAKQLRSDLSSFDMLRYVETLLTHMGVNPLEAEELIRDEDSPDFEFIVYDSWKITGRTAENTFNKTHTFHFLLGSIYGECPVPKPRVDRPRKVPVIQEERAMPAQLRRMEESHQEATEKEVERILGLLQTYFREDPDTPMSFFDFVVDPHSFPRTVENIFHVSFIIRDGFARIRLDQDRLPVIEPVSINEENEGFEHNTQVRNQGIIALSYRDWEEIVKTFEISEPVITPSQRQQKPSA

SEQ ID NO: 3011 - protein, 325 aa, Homo sapiens
MKRLGSVQRKMPCVFVTEVKEEPSSKREHQPFKVLATETVSHKALDADIYSAIPTEKVDGTCCYVTTYKDQPYLWARLDRKPNKQAEKRFKNFLHSKENPKEFFWNVEEDFKPAPECWIPAKETEQINGNPVPDENGHIPGWVPVEKNNKQYCWHSSVVNYEFEIALVLKHHPDDSGLLEISAVPLSDLLEQTLELIGTNINGNPYGLGSKKHPLHLLIPHGAFQIRNLPSLKHNDLVSWFEDCKEGKIEGIVWHCSDGCLIKVHRHHLGLCWPIPDTYMNSRPVIINMNLNKCDSAFDIKCLFNHFLKIDNQKFVRLKDIIFDV

SEQ ID NO: 3012 - protein, 269 aa, Homo sapiens
MKTPVELAVSGMQTLGLQHRCRGGYRVKARTSYVDETLFGSPAGTRPTPPDFDPPWVEKANRTRGVGKEASKALGAKGSCETTPSRGSTPTLTPRKKNKYRPISHTPSYCDESLFGSRSEGASFGAPRMAKGDAAKLRALLWTPPPTPRGSHSPRPREAPLRAIHPAGPSKTEPGPAADSQKLSMGGLHSSRPLKRGLSHSLTHLNVPSTGHPATSAPHTNGPQDLRPSTSGVTFRSPLVTSRARSVSISVPSTPRRGGATQKPKPPWK

SEQ ID NO: 3013 - protein, 757 aa, Homo sapiens
MSRKISKESKKVNISSSLESEDISLETTVPTDDISSSEEREGKVRITRQLIERKELLHNIQLLKIELSQKTMMIDNLKVDYLTKIEELEEKLNDALHQKQLLTLRLDNQLAFQQKDASKYQELMKQEMETILLRQKQLEETNLQLREKAGDVRRNLRDFELTEEQYIKLKAFPEDQLSIPEYVSVRFYELVNPLRKEICELQVKKNILAEELSTNKNQLKQLTETYEEDRKNYSEVQIRCQRLALELADTKQLIQQGDYRQENYDKVKSERDALEQEVIELRRKHEILEASHMIQTKERSELSKEVVTLEQTVTLLQKDKEYLNRQNMELSVRCAHEEDRLERLQAQLEESKKAREEMYEKYVASRDHYKTEYENKLHDELEQIRLKTNQEIDQLRNASREMYERENRNLREARDNAVAEKERAVMAEKDALEKHDQLLDRYRELQLSTESKVTEFLHQSKLKSFESERVQLLQEETARNLTQCQLECEKYQKKLEVLTKEFYSLQASSEKRITELQAQNSEHQARLDIYEKLEKELDEIIMQTAEIENEDEAERVLFSYGYGANVPTTAKRRLKQSVHLARRVLQLEKQNSLILKDLEHRKDQVTQLSQELDRANSLLNQTQQPYRYLIESVRQRDSKIDSLTESIAQLEKDVSNLNKEKSALLQTKNQMALDLEQLLNHREELAAMKQILVKMHSKHSENSLLLTKTEPKHVTENQKSKTLNVPKEHEDNIFTPKPTLFTKKEAPEWSKKQKMKT

SEQ ID NO: 3014 - protein, 173 aa, Homo sapiens
MMAQLFLLQANAVLPLSHEIKVKRQIRLPAPLYPPERNDSRSFQIPQDLREKGWEEGQQHFAGKAADAFPAPVQLEGLEAGQTTLASPEVGPWRPKRLSGVCLLSALLPDPCKTNGTFLLQKHHLPSLLAVILFPVIILTGASFAHLFVALFVSHLLLKLPLGAGMRMQRDAR

SEQ ID NO: 3015 - protein, 647 aa, Homo sapiens
MTVGRPEGAPGGAEGSRQIFPPESFADTEAGEELSGDGLVLPRASKLDEFLSPEEEMDSTSDSTGSIYQNLQELKQKGRWCLLESLFQSDPESDENLSEDEEDLESFFQDKDRGMVQVQCPQALRCGSTRRCSSLNNLPSNIPRPQTQPPSGSRPPSQHRSVSSWASSITVPRPFRMTLREARKKAEWLGSPASFEQERQRAQRQGEEEAECHRQFRAQPVPAHVYLPLYQEIMERSEARRQAGIQKRKELLLSSLKPFSFLEKEEQLKEAARQRDLAATAEAKISKQKATRRIPKSILEPALGDKLQEAELFRKIRIQMRALDMLQMASSPIASSSNRANPQPRTATRTQQEKLGFLHTNFRFQPRVNPVVPDYEGLYKAFQRRAAKRRETQEATRNKPFLLRTANLRHPQRPCDAATTGRRQDSPQPPATPLPRSRSLSGLASLSANTLPVHITDATRKRESAVRSALEKKNKADESIQWLEIHRKKSQAMSKSVTLRAKAMDPHKSLEEVFKAKLKENRNNDRKRAKEYKKELEEMKQRIQTRPYLFEQVAKDLAKKEAEQWYLDTLKQAGLEEDFVRNKGQGTRAVQEKETKIKDFPRFQETTKLSIRDPEQGLEGSLEQPASPRKVLEELSHQSPENLVSLA

SEQ ID NO: 3016 - protein, 347 aa, Homo sapiens
MVASTVANGPRSPWDAISLIIMLRIWRVKRVIDAYVLPVKLEMEMVIQQYEKAKVIQDEQLERLTQICQEQGFEIRQLRAHLAQQDLDLAAEREAALQAPHVLSQPRSRFKVLEAGTWDEETAAESVVEELQPSQEATMKDDMNSYISQYYNGPSSDSGVPEPAVCMVTTAAIDIHQPNISSDLFSLDMPLKLGGNGTSATSESASRSSVTRAQSDSSQTLGSSMDCSTAREEPSSEPGPSPPPLPSQQQVEEATVQDLLSSLSEDPCPSQKALDPAPLARPSPAGSAQTSPELEHRVSLFNQKNQEGFTVFQIRPVIHFQPTVPMLEDKFRSLESKEQKLHRVPEA

SEQ ID NO: 3017 - protein, 705 aa, Homo sapiens
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKLGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 3018 - protein, 1530 aa, Homo sapiens
MSHSHPAGLLAAYNSLMDKHLAGYFNNTRIRRHLLRSGLITRSGRILSEKEYKLNMMKRDHQKYIRECLAQAIFHKVLDMERYHQLEIKKKLETLARKERIQRFKGEHTRRSVENNMPILSPHPPVGPKSNRGHSVLVDEGHSSPLALTAPRPYTAPGNMQPPIRLQPLPSNPAVETVPKVTSRSRSKTSLLENEALFPIGGKKAVMKFRNSIGNSQRMNSYQLPNINSYMMPIPPPLPPTGKITRENRSETWRRRRFRPTTAPNGLEPLLTKDSRRIHKTSLHSNAAITMIYLGKNVHLSSDNPDFRDEIKVYQQHCGGENLCVYKGKLLEKETFQFISKRHHGFPFSLTFFLNGMQVNRLSSCCEYKHRKGSRLGGKRGYFGFVCVERSSPCYKCIIAMGLDKKPSLPKSRKEKSTEKGEELKKAEGKVRKEREYVIPKRNEIKENKTSVSAKFSAQEIKTGLKEVVTAVEEMTSKGKPGQEVLEDDQENTLKYEYEEDFEVDEEKQGEKSNEEGQADVQMNGIPQSPLDDKKDNLDPEKESETSSQKAPDARDNVKDENDGCSESELEEDKQDMKTASSTSSRSHPYSSDSEDESAVGDREAHTDSSTDESARRSSSQELSENDKPRKSHLPIEESLEIEIEDQEITKADVETKPMPIDESFENVLKEGTEKGTQEIAEGLSEKSGKHVSAEEKEKDKSKLWEESTAQVKDKKAGLPGLEEGGKDSLPLAYVLALGAPTMNFMVDETAAINSNKESQQLVQKTYTLEKKEAMEEDEAPQHRDADIVQGKGEAALWGEAGAVHEAPLRAWKPTAEQPELAEEFTEKREIPPGIERGAEGAAEAEGVRRLGEGGSDPIGQAAAKDAVGLSKDEAPEKQALMLTVLETDKAASEGEQGLEKAVLANEAAALNLEHLHEVAALREAATSEEGEAEGGVAVSDVGESEEEASIDLEDTGPMEDTASKREDGSEEAILGGEEPAKERKEVMRTETRLSPFTGEAEASRMQVSEGSPEEGSLAKEAFLCKEDVEGEEMVTEAEANREDDRKEILPKELDLARERRKAERPKTSLRKTDSEREEVTRANALKDEDAFKEEQKLKAEEGETETEVRAEEETKAPPNEMGSDAENEAPVEASELSDNPGLLGEDSLKETVVPIFEATPGFEKSLENITALRKEGGGERLSEARDTEHKDREELSSRENRALKEGHRQDGEGALAAPEAEPAGKVQAPEGLIPATGQAEELAAKDHDSCAGLEGRAEGQGGVDVVLRTQEAVAEEDPIMAEKFREEAVDEDPEEEEDKECTLETEAMQDRNSEGDGDMEGEGNTQKNEGMGGGRVVAVEVLHGGGETAETAAEEREVLAGSETAEEKTIANKASSFSDVAEEETWHQQDELVGKTAAAGKVVVEELARSGEEVPAAEEMTVTYTTEAGVGTPGALERKTSGLGQEQEEGSEGQEAATGSGDGRQETGAAEKFRLGLSREGERELSPESLQAMATLPVKPDFTETREKQQHMVQGESETADVSPNNMQV

SEQ ID NO: 3019 - protein, 342 aa, Homo sapiens
MSEESDSLRTSPSVASLSENELPPPPEPPGYVCSLTEDLVTKAREELQEKPEWRLRDVQALRDMVRKEYPNLSTSLDDAFLLRFLRARKFDYDRALQLLVNYHSCRRSWPEVFNNLKPSALKDVLASGFLTVLPHTDPRGCHVVCIRPDRWIPSNYPITENIRAIYLTLEKLIQSEETQVNGIVILADYKGVSLSKASHFGPFIAKKVIGILQDGFPIRIKAVHVVNEPRIFKGIFAIIKPFLKEKIANRFFLHGSDLNSLHTNLPRSILPKEYGGTAGELDTATWNAVLLASEDDFVKEFCQPVPACDSILGQTLLPEGLTSDAQCDDSLRAVKSQLYSCY

SEQ ID NO: 3020 - protein, 342 aa, Homo sapiens; identical to SEQ ID NO: 3019

SEQ ID NO: 3021 - protein, 181 aa, Homo sapiens
MGDIFKNNGVLQGRLRAVACAPHRFGPRLRCLHHDQGLTELAWGTWPHSHPVRHQPQMPSARECCSIVCMAAKEVSAPKAPGSPWMVPGDVAMSGHRVGALDERGHPNPQTGHCRGGSVSVTWSSVSCCRGRLAAVRVMIARDPSTCHLAKGCSPAWGFLPQARGPAGTRTPQRRCSSHEA

SEQ ID NO: 3022 - protein, 720 aa, Homo sapiens
MDIQLDPARDDLPLMANTSHILVKHYVLDLDVDFESQVIEGTIVLFLEDGNRFKKQNSSIEEACQSESNKACKFGMPEPCHIPVTNARTFSSEMEYNDFAICSKGEKDTSDKDGNHDNQEHASGISSSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMARPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 3023 - protein, 328 aa, Homo sapiens
MGAAARLSAPRALVLWAALGAAAHIGPAPDPEDWWSYKDNLQGNFVPGPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVASTSNPFLSRLLNRDTITRISYKNDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHVDGVPHGR

SEQ ID NO: 3024 - protein, 341 aa, Homo sapiens
MPFPFGKSHKSPADIVKNLKESMAVLEKQDISDKKAEKATEEVSKNLVAMKEILYGTNEKEPQTEAVAQLAQELYNSGLLSTLVADLQLIDFEGKKDVAQIFNNILRRQIGTRTPTVEYICTQQNILFMLLKGYESPEIALNCGIMLRECIRHEPLAKIILWSEQFYDFFRYVEMSTFDIASDAFATFKDLLTRHKLLSAEFLEQHYDRFFSEYEKLLHSENYVTKRQSLKLLGELLLDRHNFTIMTKYISKPENLKLMMNLLRDKSRNIQFEAFHVFKVFVANPNKTQPILDILLKNQAKLIEFLSKFQNDRTEDEQFNDEKTYLVKQIRDLKRPAQQEA

SEQ ID NO: 3025 - protein, 1091 aa, Homo sapiens
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKNPKSQEPVTLDFLDAELENDIKVEIRNKMIDGESGEKTFRTLVKSQDERYIDKGNRTYTWTPVNGTDYSLALVLPTYSFYYIKAKLEETITQARSKKGKMKDSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 3026 - protein, 149 aa, Homo sapiens [sequence omitted]

SEQ ID NO: 3027 - protein, 588 aa, Homo sapiens
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKEARQRRQPPGHRPAPRGGGGSALVRGSPCVESCWAPAPGSPARMHPLRPEEAMEPE

SEQ ID NO: 3028 - protein, 541 aa, Homo sapiens
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKQGSEDNLQGTDPPPVGEEEVLL

SEQ ID NO: 3029 - protein, 498 aa, Homo sapiens
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKILVKTMIRKRSFGNPFEGSRREERSLSAPGNLLTKQGSEDNLQGTDPPPVGEEEVLL

SEQ ID NO: 3030 - protein, 545 aa, Homo sapiens
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKILVKTMIRKRSFGNPFEGSRREERSLSAPGNLLTKKPTRECESLSELKEARQRRQPPGHRPAPRGGGGSALVRGSPCVESCWAPAPGSPARMHPLRPEEAMEPE

SEQ ID NO: 3031 - protein, 541 aa, Homo sapiens; identical to SEQ ID NO: 3028

SEQ ID NO: 3032 - protein, 1024 aa, Homo sapiens
MNFIKDNSRALIQRMGMTVIKQITDDLFVWNVLNREEVNIICCEKVEQDAARGIIHMILKKGSESCNLFLKSLKEWNYPLFQDLNGQSLFHQTSEGDLDDLAQDLKDLYHTPSFLNFYPLGEDIDIIFNLKSTFTEPVLWRKDQHHHRVEQLTLNGLLQALQSPCIIEGESGKGKSTLLQRIAMLWGSGKCKALTKFKFVFFLRLSRAQGGLFETLCDQLLDIPGTIRKQTFMAMLLKLRQRVLFLLDGYNEFKPQNCPEIEALIKENHRFKNMVIVTTTTECLRHIRQFGALTAEVGDMTEDSAQALIREVLIKELAEGLLLQIQKSRCLRNLMKTPLFVVITCAIQMGESEFHSHTQTTLFHTFYDLLIQKNKHKHKGVAASDFIRSLDHCGDLALEGVFSHKFDFELQDVSSVNEDVLLTTGLLCKYTAQRFKPKYKFFHKSFQEYTAGRRLSSLLTSHEPEEVTKGNGYLQKMVSISDITSTYSSLLRYTCGSSVEATRAVMKHLAAVYQHGCLLGLSIAKRPLWRQESLQSVKNTTEQEILKAININSFVECGIHLYQESTSKSALSQEFEAFFQGKSLYINSGNIPDYLFDFFEHLPNCASALDFIKLDFYGGAMASWEKAAEDTGGIHMEEAPETYIPSRAVSLFFNWKQEFRTLEVTLRDFSKLNKQDIRYLGKIFSSATSLRLQIKRCAGVAGSLSLVLSTCKNIYSLMVEASPLTIEDERHITSVTNLKTLSIHDLQNQRLPGGLTDSLGNLKNLTKLIMDNIKMNEEDAIKLAEGLKNLKKMCLFHLTHLSDIGEGMDYIVKSLSSEPCDLEEIQLVSCCLSANAVKILAQNLHNLVKLSILDLSENYLEKDGNEALHELIDRMNVLEQLTALMLPWGCDVQGSLSSLLKHLEEVPQLVKLGLKNWRLTDTEIRILGAFFGKNPLKNFQQLNLAGNRVSSDGWLAFMGVFENLKQLVFFDFSTKEFLPDPALVRKLSQVLSKLTFLQEARLVGWQFDDDDLSVITGAFKLVTA

SEQ ID NO: 3033 - protein, 584 aa, Homo sapiens
MLSIPSGSGNKKSSNWNNNQNDYSSLSDSQFLFGSQFCPENSETLSAPLDFGAHLRHSKQSQQNYLEGEPSIFTKYQTKPQLFGGDIKDGGLFPPPLSVGKSKGLLEQFEEKKKRAKDKCDSETLYNFVSNVRESILRLQTSVEKSEDHLSSRSQSILDSLETVAKTLQETIQAQNDLVFEAVQDKGNMEQAILEMKKRFEARQGEFIEMKSNLKHLEVLVAQQSQEFQQLCEQLGQLNVPSVLAELKRLISVPPVKDSASQTSPPLAQSLNLTRQEKYTSEKPVLWQAQALPAAWNPGMGSLQPGEFDVWGEGAKNDDLQEEAALPAFGSHERNRHVKDKVVQTNCKNWAVTKTGAKNHGSSVPGHKIPSDRDLVSQGASQLTSLEINFSTSIKNACQKYQAQSMFLCDPREHLVIKQKDGTVEMRGKDKKQQPRKAHRAHRGRLIASKQKQIPIQTCKFNSKYQSPQPAISVPQSPFLGQQEPRAQPLHLQCPRSPRKPVCPILGGTVMPNKTVRAVQGRLLQLSRCSSQDNWLLSSSSQGDHQMSWFSDLNLGCSETPLCKEAGKNLLYDLGFDSSDDDGF

SEQ ID NO: 3034 - protein, 502 aa, Homo sapiens
MDYDFKAKLAAERERVEDLFEYEGCKVGRGTYGHVYKARRKDGKDEKEYALKQIEGTGISMSACREIALLRELKHPNVIALQKVFLSHSDRKVWLLFDYAEHDLWHIIKFHRASKANKKPMQLPRSMVKSLLYQILDGIHYLHANWVLHRDLKPANILVMGEGPERGRVKIADMGFARLFNSPLKPLADLDPVVVTFWYRAPELLLGARHYTKAIDIWAIGCIFAELLTSEPIFHCRQEDIKTSNPFHHDQLDRIFSVMGFPADKDWEDIRKMPEYPTLQKDFRRTTYANSSLIKYMEKHKVKPDSKVFLLLQKLLTMDPTKRITSEQALQDPYFQEDPLPTLDVFAGCQIPYPKREFLNEDDPEEKGDKNQQQQQNQHQQPTAPPQQAAAPPQAPPPQQNSTQTNGTAGGAGAGVGGTGAGLQHSQDSSLNQVPPNKKPRLGPSGANSGGPVMPSDYQHSSSRLNYQSSVQGSSQSQSTLGYSSSSQQSSQYHPSHQAHRY

SEQ ID NO: 3035 - protein, 1704 aa, Homo sapiens
MSSVSEVNVDIKDFLMSINLEQYLLHFHESGFTTVKDCAAINDSLLQKIGISPTGHRRRILKQLQIILSKMQDIPIYANVHKTKKNDDPSKDYHVPSSDQNICIELSNSGSVQTSSPPQLETVRKNLEDSDASVERSQYPQSDDKLSPPKRDFPTAEEPHLNLGSLNDSLFGSDNIKIESLITKKTVDHTVEEQQTEKVKLITENLSKLPNADSECLSFVGCSTSGTNSGNGTNGLLEGSPPSPFFKFQGEMIVNDLYVPSSPILAPVRSRSKLVSRPSRSFLLRHRPVPEIPGSTKGVSGSYFRERRNVATSTEKSVAWQNSNEENSSSIFPYGETFLFQRLENSKKRSIKNEFLTQGEALKGEAATATNSFIIKSSIYDNRKEKISEDKVEDIWIPREDKNNFLIDTASESEYSTVEECFQSLRRKNSKASKSRTQKALILDSVNRHSYPLSSTSGNADSSAVSSQAISPYACFYGASAKKVKSGWLDKLSPQGKRMFQKRWVKFDGLSISYYNNEKEMYSKGIIPLSAISTVRVQGDNKFEVVTTQRTFVFRVEKEEERNDWISILLNALKSQSLTSQSQAVVTPEKCGYLELRGYKAKIFTVLSGNSVWLCKNEQDFKSGLGITIIPMNVANVKQVDRTVKQSFEIITPYRSFSFTAETEKEKQDWIEAVQQSIAETLSDYEVAEKIWFNESNRSCADCKAPDPDWASINLCVVICKKCAGQHRSLGPKDSKVRSLKMDASIWSNELIELFIVIGNKRANDFWAGNLQKDEELHMDSPVEKRKNFITQKYKEGKFRKTLLASLTKEELNKALCAAVVKPDVLETMALLFSGADVMCATGDPVHSTPYLLAKKAGQSLQMEFLYHNKFSDFPQHDIHSEGVLSQESSQSTFLCDFLYQAPSAASKLSSEKKLLEETNKKWCVLEGGFLSYYENDKSTTPNGTININEVICLAIHKEDFYLNTGPIFIFEIYLPSERVFLFGAETSQAQRKWTEAIAKHFVPLFAENLTEADYDLIGQLFYKDCHALDQWRKGWFAMDKSSLHFCLQMQEVQGDRMHLRRLQELTISTMVQNGEKLDVLLLVEKGRTLYIHGHTKLDFTVWHTAIEKAAGTDGNALQDQQLSKNDVPIIVNSCIAFVTQYGLGCKYIYQKNGDPLHISELLESFKKDARSFKLRAGKHQLEDVTAVLKSFLSDIDDALLTKELYPYWISALDTQDDKERIKKYGAFIRSLPGVNRATLAAIIEHLYRVQKCSEINHMNAHNLALVFSSCLFQTKGQTSEEVNVIEDLINNYVEIFEVKEDQVKQMDIENSFITKWKDTQVSQAGDLLIEVYVERKEPDCSIIIRISPVMEAEELTNDILAIKNIIPTKGDIWATFEVIENEELERPLHYKENVLEQVLRWSSLAEPGSAYLVVKRFLTADTIKHCSDRSTLGSIKEGILKIKEEPSKILSGNKFQDRYFVLRDGFLFLYKDVKSSKHDKMFSLSSMKFYRGVKKKMKPPTSWGLTAYSEKHHWHLCCDSSRTQTEWMTSIFIAQHEYDIWPPAGKERKRSITKNPKIGGLPLIPIQHEGNATLARKNIESARAELERLRLSEKCDKESVDSSLKERASMVAHCLEHKDDKLRNRPRKHRSFNCLEDTEPEAPLGQPKGHKGLKTLRKTEDRNSKATLDSDHKLPSRVIEELNVVLQRSRTLPKELQDEQILK

SEQ ID NO: 3036 - protein, 876 aa, Homo sapiens
MALLFSGADVMCATGDPVHSTPYLLAKKAGQSLQMEFLYHNKFSDFPQHDIHSEGVLSQESSQSTFLCDFLYQAPSAASKLSSEKKLLEETNKKWCVLEGGFLSYYENDKSTTPNGTININEVICLAIHKEDFYLNTGPIFIFEIYLPSERVFLFGAETSQAQRKWTEAIAKHFVPLFAENLTEADYDLIGQLFYKDCHALDQWRKGWFAMDKSSLHFCLQMQEVQGDRMHLRRLQELTISTMVQNGEKLDVLLLVEKGRTLYIHGHTKLDFTVWHTAIEKAAGTDGNALQDQQLSKNDVPIIVNSCIAFVTQYGLGCKYIYQKNGDPLHISELLESFKKDARSFKLRAGKHQLEDVTAVLKSFLSDIDDALLTKELYPYWISALDTQDDKERIKKYGAFIRSLPGVNRATLAAIIEHLYRVQKCSEINHMNAHNLALVFSSCLFQTKGQTSEEVNVIEDLINNYVEIFEVKEDQVKQMDIENSFITKWKDTQVSQAGDLLIEVYVERKEPDCSIIIRISPVMEAEELTNDILAIKNIIPTKGDIWATFEVIENEELERPLHYKENVLEQVLRWSSLAEPGSAYLVVKRFLTADTIKHCSDRSTLGSIKEGILKIKEEPSKILSGNKFQDRYFVLRDGFLFLYKDVKSSKHDKMFSLSSMKFYRGVKKKMKPPTSWGLTAYSEKHHWHLCCDSSRTQTEWMTSIFIAQHEYDIWPPAGKERKRSITKNPKIGGLPLIPIQHEGNATLARKNIESARAELERLRLSEKCDKESVDSSLKERASMVAHCLEHKDDKLRNRPRKHRSFNCLEDTEPEAPLGQPKGHKGLKTLRKTEDRNSKATLDSDHKLPSRVIEELNVVLQRSRTLPKELQDEQILK

SEQ ID NO: 3037 - protein, 1224 aa, Homo sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 3038 - protein, 459 aa, Homo sapiens
MALTLFDTDEYRPPVWKSYLYQLQQEAPHPRRITCTCEVENRPKYYGREFHGMISREAADQLLIVAEGSYLIRESQRQPGTYTLALRFGSQTRNFRLYYDGKHFVGEKRFESIHDLVTDGLITLYIETKAAEYIAKMTINPIYEHVGYTTLNREPAYKKHMPVLKETHDERDSTGQDGVSEKRLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 3039 - protein, 459 aa, Homo sapiens; identical to SEQ ID NO: 3038

SEQ ID NO: 3040 - protein, 210 aa, Homo sapiens
MATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARFGISSVPTKGLSSDNKPMVNLDKLKERAQRFGLNVSSISRKSEDDEKLKKRKERFGIVTSSAGTGTTEDTEAKKRKRAERFGIA

SEQ ID NO: 3041 - protein, 1028 aa, Homo sapiens
MMFPWKQLILLSFIGCLGGELLLQGPVFIKEPSNSIFPVGSEDKKITLHCEARGNPSPHYRWQLNGSDIDMSMEHRYKLNGGNLVVINPNRNWDTGTYQCFATNSLGTIVSREAKLQFAYLENFKTKMRSTVSVREGQGVVLLCGPPPHSGELSYAWIFNEYPSFVEEDSRRFVSQETGHLYISKVEPSDVGNYTCVVTSMVTNARVLGSPTPLVLRSDGVMGEYEPKIEVQFPETLPAAKGSTVKLECFALGNPIPQINWRRSDGLPFSSKIKLRKFSGVLEIPNFQQEDAGSYECIAENSRGKNVARGRLTYYAKPHWVQLIKDVEIAVEDSLYWECRASGKPKPSYRWLKNGAALVLEERTQIENGALTISNLSVTDSGMFQCIAENKHGLVYSSAELKVVASAPDFSKNPMKKLVQVQVGSLVSLDCKPRASPRALSSWKKGDVSVQEHERISLLNDGGLKIANVTKADAGTYTCMAENQFGKANGTTHLVVTEPTRITLAPSNMDVSVGESVILPCQVQHDPLLDIIFTWYFNGALADFKKDGSHFEKVGGSSSGDLMIRNIQLKHSGKYVCMVQTGVDSVSSAADLIVRGSPGPPENVKVDEITDTTAQLSWKEGKDNHSPVISYSIQARTPFSVGWQTVTTVPEVIDGKTHTATVVELNPWVEYEFRVVASNKIGGGEPSLPSEKVRTEEAVPEVPPSEVNGGGGSRSELVITWDPVPEELQNGEGFGYVVAFRPLGVTTWIQTVVTSPDTPRYVFRNESIVPYSPYEVKVGVYNNKGEGPFSPVTTVFSAEEEPTVAPSQVSANSLSSSEIEVSWNTIPWKLSNGHLLGYEVRYWNGGGKEESSSKMKVAGNETSARLRGLKSNLAYYTAVRAYNSAGAGPFSATVNVTTKKTPPSQPPGNVVWNATDTKVLLNWEQVKAMENESEVTGYKVFYRTSSQNNVQVLNTNKTSAELVLPIKEDYIIEVKATTDGGDGTSSEQIRIPRITSMDARGSTSAISNVHPMSSYMPIVLFLIVYVLW

SEQ ID NO: 3042 - protein, 624 aa, Homo sapiens
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKPYSRSSSMSSIDLVSASDDVHRFSSQVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 3043 - protein, 598 aa, Homo sapiens
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 3044 - protein, 255 aa, Homo sapiens
MIKKFDKKDEESGSGSNPFQHLEKSAVLQEARIFNETPINPRRCLHILTKILYLLNQGEHFGTTEATEAFFAMTRLFQSNDQTLRRMCYLTIKEMATISEDVIIVTSSLTKDMTGKEDVYRGPAIRALCRITDGTMLQAIERYMKQAIVDKVSSVSSSALVSSLHMMKISYDVVKRWINEAQEAASSDNIMVQYHALGVLYHLRKNDRLAVSKMLNKFTKSGLKSQFAYCMLIRIASRLLKETEDGHLQAPLAAP

SEQ ID NO: 3045 - protein, 803 aa, Homo sapiens
MAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWGGQHHGLRGVLAAALFASCLWGALIFTLHVALRLLLSYHGWLLEPHGAMSSPTKTWLALVRIFSGRHPMLFSYQRSLPRQPVPSVQDTVRKYLESVRPILSDEDFDWTAVLAQEFLRLQASLLQWYLRLKSWWASNYVSDWWEEFVYLRSRNPLMVNSNYYMMDFLYVTPTPLQAARAGNAVHALLLYRHRLNRQEIPPTLLMGMRPLCSAQYEKIFNTTRIPGVQKDYIRHLHDSQHVAVFHRGRFFRMGTHSRNSLLSPRALEQQFQRILDDPSPACPHEEHLAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRDRGQFCLTYESAMTRLFLEGRTETVRSCTREACNFVRAMEDKEKTDPQCLALFRVAVDKHQALLKAAMSGQGVDRHLFALYIVSRFLHLQSPFLTQVHSEQWQLSTSQIPVQQMHLFDVHNYPDYVSSGGGFGPADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 3046 - protein, 1285 aa, Homo sapiens
MALARPGTPDPQALASVLLLLLWAPALSLLAGTVPSEPPSACASDPCAPGTECQATESGGYTCGPMEPRGCATQPCHHGALCVPQGPDPTGFRCYCVPGFQGPRCELDIDECASRPCHHGATCRNLADRYECHCPLGYAGVTCEMEVDECASAPCLHGGSCLDGVGSFRCVCAPGYGGTRCQLDLDECQSQPCAHGGTCHDLVNGFRCDCAGTGYEGTHCEREVLECASAPCEHNASCLEGLGSFRCLCWPGYSGELCEVDEDECASSPCQHGGRCLQRSDPALYGGVQAAFPGAFSFRHAAGFLCHCPPGFEGADCGVEVDECASRPCLNGGHCQDLPNGFQCHCPDGYAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEAPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRLPVPSKECSLNVTCLDGSPCEGGSPAANCSCLEGLAGQRCQVPTLPCEANPCLNGGTCRAAGGVSECICNARFSGQFCEVAKGLPLPLPFPLLEVAVPAACACLLLLLLGLLSGILAARKRRQSEGTYSPSQQEVAGARLEMDSVLKVPPEERLI

SEQ ID NO: 3047 - protein, 290 aa, Homo sapiens
MSVRRGRRPARPGTRLSWLLCCSALLSPAAGYVIVSSVSWAVTNEVDEELDSASTEEAMPALLEDSGSIWQQSFPASAHKEDAHLRPRAGAARARPPPAPPGMFSYRREGGQTASAPPGPRLRAATARSLAHASVWGCLATVSTHKKIQGLPFGNCLPVSDGPFNNSTGIPFFYMTAKDPVVADLMKNPMASLMLPESEGEFCRKNIVDPEDPRCVQLTLTGQMIAVSPEEVEFAKQAMFSRHPGMRKWPRQYEWFFMKMRIEHIWLQKWYGGASSISREEYFKAVPRKA

SEQ ID NO: 3048 - protein, 168 aa, Homo sapiens
MEPPNLYPVKLYVYDLSKGLARRLSPIMLGKQLEGIWHTSIVVHKDEFFFGSGGISSCPPGGTLLGPPDSVVDVGSTEVTEEIFLEYLSSLGESLFRGEAYNLFEHNCNTFSNEVAQFLTGRKIPSYITDLPSEVLSTPFGQALRPLLDSIQIQPPGGSSVGRPNGQS

SEQ ID NO: 3049 - protein, 555 aa, Homo sapiens
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQTILEEDVEDPVYQYIVFEAGHEPIRDPETEENIYQVPTSQKKEGVYDVPKSQPVSAVTQLELFGDMSTPPDITSPPTPATPGDAFIPSSSQTLPASADVFSSVPFGTAAVPSGYVAMGAVLPSFWGQQPLVQQQMVMGAQPPVAQVMPGAQPIAWGQPGLFPATQQPWPTVAGQFPPAAFMPTQTVMPLPAAMFQGPLTPLATVPGTSDSTRSSPQTDKPRQKMGKETFKDFQMAQPPPVPSRKPDQPSLTCTSEAFSSYFNKVGVAQDTDDCDDFDISQLNLTPVTSTTPSTNSPPTPAPRQSSPSKSSASHASDPTTDDIFEEGFESPSKSEEQEAPDGSQASSNSDPFGEPSGEPSGDNISPQAGS

SEQ ID NO: 3050 - protein, 350 aa, Homo sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHSHSLVYVCKPTFVGSRDQDGEILLPREVPDEYEVGSFMEEVRQELEDLERSLTEEMALREPAAAAAALLGGEEI

SEQ ID NO: 3051 - protein, 350 aa, Homo sapiens; identical to SEQ ID NO: 3050

SEQ ID NO: 3052 - protein, 350 aa, Homo sapiens; identical to SEQ ID NO: 3050

SEQ ID NO: 3053 - protein, 1966 aa, Homo sapiens
MWIPTEHEKYGVVIASFRGTVPYGLSLEIGDTVQILEKCDGWYRGFALKNPNIKGIFPSSYVHLKNACVKNKGQFEMVIPTEDSVITEMTSTLRDWGTMWKQLYVRNEGDLFHRLWHIMNEILDLRRQVLVGHLTHDRMKDVKRHITARLDWGNEQLGLDLVPRKEYAMVDPEDISITELYRLMEHRHRKKDTPVQASSHHLFVQMKSLMCSNLGEELEVIFSLFDSKENRPISERFFLRLNRNGLPKAPDKPERHCSLFVDLGSSELRKDIYITVHIIRIGRMGAGEKKNACSVQYRRPFGCAVLSIADLLTGETKDDLILKVYMCNTESEWYQIHENIIKKLNARYNLTGSNAGLAVSLQLLHGDIEQIRREYSSVFSHGVSITRKLGFSNIIMPGEMRNDLYITIERGEFEKGGKSVARNVEVTMFIVDSSGQTLKDFISFGSGEPPASEYHSFVLYHNNSPRWSELLKLPIPVDKFRGAHIRFEFRHCSTKEKGEKKLFGFSFVPLMQEDGRTLPDGTHELIVHKCEENTNLQDTTRYLKLPFSKGIFLGNNNQAMKATKESFCITSFLCSTKLTQNGDMLDLLKWRTHPDKITGCLSKLKEIDGSEIVKFLQDTLDTLFGILDENSQKYGSKVFDSLVHIINLLQDSKFHHFKPVMDTYIESHFAGALAYRDLIKVLKWYVDRITEAERQEHIQEVLKAQEYIFKYIVQSRRLFSLATGGQNEEEFRCCIQELLMSVRFFLSQESKGSGALSQSQAVFLSSFPAVYSELLKLFDVREVANLVQDTLGSLPTILHVDDSLQAIKLQCIGKTVESQLYTNPDSRYILLPVVLHHLHIHLQEQKDLIMCARILSNVFCLIKKNSSEKSVLEEIDVIVASLLDILLRTILEITSRPQPSSSAMRFQFQDVTGEFVACLLSLLRQMTDRHYQQLLDSFNTKEELRDFLLQIFTVFRILIRPEMFPKDWTVMRLVANNVIITTVLYLSDALRKNFLNENFDYKIWDSYFYLAVIFINQLCLQLEMFTPSKKKKVLEKYGDMRVTMGCEIFSMWQNLGEHKLHFIPALIGPFLEVTLIPQPGLRNVMIPIFHDMMDWEQRRSGNFKQVEAKLIDKLDSLMSEGKGDETYRELFNSILLKKIERETWRESGVSLIATVTRLMERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARASPLLSDKHKHSRENSCLSPRERPCSAIYPTPVEPSQRMLFNHIGDGALPRSDPNLSAPEKAVNPTPSSWSLDSGKEAKNMSDSGKLISPPVPPRPTQTASPARHTTSVSPSPAGRSPLKGSVQSFTPSPVEYHSPGLISNSPVLSGSYSSGISSLSRCSTSETSGFENQVNEQSAPLPVPVPVPVPSYGGEEPVRKESKTPPPYSVYERTLRRPVPLPHSLSIPVTSEPPALPPKPLAARSSHLENGARRTDPGPRPRPLPRKVSQL

SEQ ID NO: 3054 - protein, 716 aa, Homo sapiens
MMSIRQRREIRATEVSEDFPAQEENVKLENKLPSGCTSRRLWKILSLTIGGTIALCIGLLTSVYLATLHENDLWFSNIKEVEREISFRTECGLYYSYYKQMLQAPTLVQGFHGLIYDNKTESMKTINLLQRMNIYQEVFLSILYRVLPIQKYLEPVYFYIYTLFGLQAIYVTALYITSWLLSGTWLSGLLAAFWYVTNRIDTTRVEFTIPLRENWALPFFAIQIAAITYFLRPNLQPLSERLTLLAIFISTFLFSLTWQFNQFMMLMQALVLFTLDSLDMLPAVKATWLYGIQITSLLLVCILQFFNSMILGSLLISFNLSVFIARKLQKNLKTGSFLNRLGKLLLHLFMVLCLTLFLNNIIKKILNLKSDEHIFKFLKAKFGLGATRDFDANLYLCEEAFGLLPFNTFGRLSDTLLFYAYIFVLSITVIVAFVVAFHNLSDSTNQQSVGKMEKGTVDLKPETAYNLIHTILFGFLALSTMGMKYLWTSHMCVFASFGLCSPEIWELLLKSVHLYNPKRICIMRYSVPILILLYLCYKFWPGMMDELSELREFYDPDTVELMNWINSNTPRKAVFAGSMQLLAGVKLCTGRTLTNHPHYEDSSLRERTRAVYQIYAKRAPEEVHALLRSFGTDYVILEDSICYERRHRRGCRLRDLLDIANGHMMDGPGENDPDLKPADHPRFCEEIKRNLPPYVAYFTRVFQNKTFHVYKLSRNK

SEQ ID NO: 3055 - protein, 2649 aa, Homo sapiens
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEIKRCKETSEHGAYSDLLQRQKATVLENSKLTGKISELERMVAELKKQKSRVEEELPKVREAAENELRKQQRNVEDISLQKIRAESEAKQYRRELETIVREKEAAERELERVRQLTIEAEAKRAAVEENLLNFRNQLEENTFTRRTLEDHLKRKDLSLNDLEQQKNKLMEELRRKRDNEEELLKLIKQMEKDLAFQKQVAEKQLKEKQKIELEARRKITEIQYTCRENALPVCPITQATSCRAVTGLQQEHDKQKAEELKQQVDELTAANRKAEQDMRELTYELNALQLEKTSSEEKARLLKDKLDETNNTLRCLKLELERKDQAEKGYSQQLRELGRQLNQTTGKAEEAMQEASDLKKIKRNYQLELESLNHEKGKLQREVDRITRAHAVAEKNIQHLNSQIHSFRDEKELERLQICQRKSDHLKEQFEKSHEQLLQNIKAEKENNDKIQRLNEELEKSNECAEMLKQKVEELTRQNNETKLMMQRIQAESENIVLEKQTIQQRCEALKIQADGFKDQLRSTNEHLHKQTKTEQDFQRKIKCLEEDLAKSQNLVSEFKQKCDQQNIIIQNTKKEVRNLNAELNASKEEKRRGEQKVQLQQAQVQELNNRLKKVQDELHLKTIEEQMTHRKMVLFQEESGKFKQSAEEFRKKMEKLMESKVITENDISGIRLDFVSLQQENSRAQENAKLCETNIKELERQLQQYREQMQQGQHMEANHYQKCQKLEDELIAQKREVENLKQKMDQQIKEHEHQLVLLQCEIQKKSTAKDCTFKPDFEMTVKECQHSGELSSRNTGHLHPTPRSPLLRWTQEPQPLEEKWQHRVVEQIPKEVQFQPPGAPLEKEKSQQCYSEYFSQTSTELQITFDETNPITRLSEIEKIRDQALNNSRPPVRYQDNACEMELVKVLTPLEIAKNKQYDMHTEVTTLKQEKNPVPSAEEWMLEGCRASGGLKKGDFLKKGLEPETFQNFDGDHACSVRDDEFKFQGLRHTVTARQLVEAKLLDMRTIEQLRLGLKTVEEVQKTLNKFLTKATSIAGLYLESTKEKISFASAAERIIIDKMVALAFLEAQAATGFIIDPISGQTYSVEDAVLKGVVDPEFRIRLLEAEKAAVGYSYSSKTLSVFQAMENRMLDRQKGKHILEAQIASGGVIDPVRGIRVPPEIALQQGLLNNAILQFLHEPSSNTRVFPNPNNKQALYYSELLRMCVFDVESQCFLFPFGERNISNLNVKKTHRISVVDTKTGSELTVYEAFQRNLIEKSIYLELSGQQYQWKEAMFFESYGHSSHMLTDTKTGLHFNINEAIEQGTIDKALVKKYQEGLITLTELADSLLSRLVPKKDLHSPVAGYWLTASGERISVLKASRRNLVDRITALRCLEAQVSTGGIIDPLTGKKYRVAEALHRGLVDEGFAQQLRQCELVITGIGHPITNKMMSVVEAVNANIINKEMGIRCLEFQYLTGGLIEPQVHSRLSIEEALQVGIIDVLIATKLKDQKSYVRNIICPQTKRKLTYKEALEKADFDFHTGLKLLEVSEPLMTGISSLYYSS

SEQ ID NO: 3056 - protein, 5171 aa, Homo sapiens
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 3057 - protein, 3062 aa, Homo sapiens
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKLDKVIAGTIDQTTGEVLSVFQAVLRGLIDYDTGIRLLETQLMISGLISPELRKCFDLKDAKSHGLIDEQILCQLKELSKAKEIISAASPTTIPVLDALAQSMITESMAIKVLEILLSTGSLVIPATGEQLTLQKAFQQNLVSSALFSKVLERQNMCKDLIDPCTSEKVSLIDMVQRSTLQENTGMWLLPVRPQEGGRITLKCGRNISILRAAHEGLIDRETMFRLLSAQLLSGGLINSNSGQRMTVEEAVREGVIDRDTASSILTYQVQTGGIIQSNPAKRLTVDEAVQCDLITSSSALLVLEAQRGYVGLIWPHSGEIFPTSSSLQQELITNELAYKILNGRQKIAALYIPESSQVIGLDAAKQLGIIDNNTASILKNITLPDKMPDLGDLEACKNARRWLSFCKFQPSTVHDYRQEEDVFDGEEPVTTQTSEETKKLFLSYLMINSYMDANTGQRLLLYDGDLDEAVGMLLEGCHAEFDGNTAIKECLDVLSSSGVFLNNASGREKDECTATPSSFNKCHCGEPEHEETPENRKCAIDEEFNEMRNTVINSEFSQSGKLASTISIDPKVNSSPSVCVPSLISYLTQTELADISMLRSDSENILTNYENQSRVETNERANECSHSKNIQNFPSDLIENPIMKSKMSKFCGVNETENEDNTNRDSPIFDYSPRLSALLSHDKLMHSQGSFNDTHTPESNGNKCEAPALSFSDKTMLSGQRIGEKFQDQFLGIAAINISLPGEQYGQKSLNMISSNPQVQYHNDKYISNTSGEDEKTHPGFQQMPEDKEDESEIEEYSCAVTPGGDTDNAIVSLTCATPLLDETISASDYETSLLNDQQNNTGTDTDSDDDFYDTPLFEDDDHDSLLLDGDDRDCLHPEDYDTLQEENDETASPADVFYDVSKENENSMVPQGAPVGSLSVKNKAHCLQDFLMDVEKDELDSGEKIHLNPVGSDKVNGQSLETGSERECTNILEGDESDSLTDYDIVGGKESFTASLKFDDSGSWRGRKEEYVTGQEFHSDTDHLDSMQSEESYGDYIYDSNDQDDDDDDGIDEEGGGIRDENGKPRCQNVAEDMDIQLCASILNENSDENENINTMILLDKMHSCSSLEKQQRVNVVQLASPSENNLVTEKSNLPEYTTEIAGKSKENLLNHEMVLKDVLPPIIKDTESEKTFGPASISHDNNNISSTSELGTDLANTKVKLIQGSELPELTDSVKGKDEYFKNMTPKVDSSLDHIICTEPDLIGKPAEESHLSLIASVTDKDPQGNGSDLIKGRDGKSDILIEDETSIQKMYLGEGEVLVEGLVEEENRHLKLLPGKNTRDSFKLINSQFPFPQITNNEELNQKGSLKKATVTLKDEPNNLQIIVSKSPVQFENLEEIFDTSVSKEISDDITSDITSWEGNTHFEESFTDGPEKELDLFTYLKHCAKNIKAKDVAKPNEDVPSHVLITAPPMKEHLQLGVNNTKEKSTSTQKDSPLNDMIQSNDLCSKESISGGGTEISQFTPESIEATLSILSRKHVEDVGKNDFLQSERCANGLGNDNSSNTLNTDYSFLEINNKKERIEQQLPKEQALSPRSQEKEVQIPELSQVFVEDVKDILKSRLKEGHMNPQEVEEPSACADTKILIQNLIKRITTSQLVNEASTVPSDSQMSDSSGVSPMTNSSELKPESRDDPFCIGNLKSELLLNILKQDQHSQKITGVFELMRELTHMEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQVS

SEQ ID NO: 3058 - protein, 5497 aa, Homo sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 3059 - protein, 452 aa, Homo sapiens
MEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEGSNIQGSVICNNAVIEKGADIKDCLIGSGQRIEAKAKRVNEVIVGNDQLMEI

SEQ ID NO: 3060 - protein, 407 aa, Homo sapiens
MSGGSADYNREHGGPEGMDPDGVIESNWNEIVDNFDDMNLKESLLRGIYAYGFEKPSAIQQRAIIPCIKGYDVIAQAQSGTGKTATFAISILQQLEIEFKETQALVLAPTRELAQQIQKVILALGDYMGATCHACIGGTNVRNEMQKLQAEAPHIVVGTPGRVFDMLNRRYLSPKWIKMFVLDEADEMLSRGFKDQIYEIFQKLNTSIQVVLLSATMPTDVLEVTKKFMRDPIRILVKKEELTLEGIKQFYINVEREEWKLDTLCDLYETLTITQAVIFLNTRRKVDWLTEKMHARDFTVSALHGDMDQKERDVIMREFRSGSSRVLITTDLLARGIDVQQVSLVINYDLPTNRENYIHRIGRGGRFGRKGVAINFVTEEDKRILRDIETFYNTTVEEMPMNVADLI

SEQ ID NO: 3061 - protein, 100 aa, Homo sapiens
MSTSTSCPIPGGRDQLPDCYSTTPGGTLYATTPGGTRIIYDRKFLLECKNSPIARTPPCCLPQIPGVTTPPTAPLSKLEELKEQETEEEIPDDAQFEMDI

SEQ ID NO: 3062 - protein, 247 aa, Homo sapiens
MQVVKEQVMRALTTKPSSLDQFKSKLQNLSYTEILKIRQSERMNQEDFQSRPILELKEKIQPEILELIKQQRLNRLVEGTCFRKLNARRRQDKFWYCRLSPNHKVLHYGDLEESPQGEVPHDSLQDKLPVADIKAVVTGKDCPHMKEKGALKQNKEVLELAFSILYDSNCQLNFIAPDKHEYCIWTDGLNALLGKDMMSDLTRNDLDTLLSMEIKLRLLDLENIQIPDAPPPIPKEPSNYDFVYDCN

SEQ ID NO: 3063 - protein, 727 aa, Homo sapiens
MPPPADIVKVAIEWPGAYPKLMEIDQKKPLSAIIKEVCDGWSLANHEYFALQHADSSNFYITEKNRNEIKNGTILRLTTSPAQNAQQLHERIQSSSMDAKLEALKDLASLSRDVTFAQEFINLDGISLLTQMVESGTERYQKLQKIMKPCFGDMLSFTLTAFVELMDHGIVSWDTFSVAFIKKIASFVNKSAIDISILQRSLAILESMVLNSHDLYQKVAQEITIGQLIPHLQGSDQEIQTYTIAVINALFLKAPDERRQEMANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFINHVNPAMDFTQTPPGMLALDNMLYFAKHHQDAYIRIVLENSSREDKHECPFGRSSIELTKMLCEILKVGELPSETCNDFHPMFFTHDRSFEEFFCICIQLLNKTWKEMRATSEDFNKVMQVVKEQVMRALTTKPSSLDQFKSKLQNLSYTEILKIRQSERMNQEDFQSRPILELKEKIQPEILELIKQQRLNRLVEGTCFRKLNARRRQDKFWYCRLSPNHKVLHYGDLEESPQGEVPHDSLQDKLPVADIKAVVTGKDCPHMKEKGALKQNKEVLELAFSILYDSNCQLNFIAPDKHEYCIWTDGLNALLGKDMMSDLTRNDLDTLLSMEIKLRLLDLENIQIPDAPPPIPKEPSNYDFVYDCN

SEQ ID NO: 3064 - protein, 247 aa, Homo sapiens; identical to SEQ ID NO: 3062

SEQ ID NO: 3065 - protein, 281 aa, Homo sapiens
MAFSDLTSRTVHLYDNWIKDADPRVEDWLLMSSPLPQTILLGFYVYFVTSLGPKLMENRKPFELKKAMITYNFFIVLFSVYMCYEFVMSGWGIGYSFRCDIVDYSRSPTALRMARTCWLYYFSKFIELLDTIFFVLRKKNSQVTFLHVFHHTIMPWTWWFGVKFAAGGLGTFHALLNTAVHVVMYSYYGLSALGPAYQKYLWWKKYLTSLQLVQFVIVAIHISQFFFMEDCKYQFPVFACIIMSYSFMFPLLFLHFWYRAYTKGQRLPKTVKNGTCKNKDN

SEQ ID NO: 3066 - protein, 157 aa, Homo sapiens
MLVLLAGIFVVHIATVIMLFVSTIANVWLVSNTVDASVGLWKNCTNISCSDSLSYASEDALKTVQAFMILSIIFCVIALLVFVFQLFTMEKGNRFFLSGATTLVCWLCILVGVSIYTSHYANRDGTQYHHGYSYILGWICFCFSFIIGVLYLVLRKK

SEQ ID NO: 3067 - protein, 592 aa, Homo sapiens
MEMQDLTSPHSRLSGSSESPSGPKLGNSHINSNSMTPNGTEVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 3068 - protein, 592 aa, Homo sapiens; identical to SEQ ID NO: 3067

SEQ ID NO: 3069 - protein, 557 aa, Homo sapiens
MEMQDLTSPHSRLSGSSESPSGPKLGNSHINSNSMTPNGTEVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 3070 - protein, 98 aa, Homo sapiens
MATHCPLYCVGADLMMNRAGEHVWSESEDCLPFLQLAQDYISSCGKKTLHEVLEKVFKSFRPLLGLPDADDDAFEEYSADVEEEEPEADHPQMGVSQQ

SEQ ID NO: 3071 - protein, 4588 aa, Homo sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDFFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSIVTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDARRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVHQHTLTVMVRDQDVPVKRNFARIVVNVSDTNDHAPWFTASSYKGRVYESAAVGSVVLQVTALDKDKGKNAEVLYSIESGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGNPINEPLFYHILNPDRRFKISRTSGVLSTTGTPFDREQQEAFDVVVEVTEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNDNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKVLASDADEGSNADITYAIEADSESVKENLEINKLSGVITTKESLIGLENEFFTFFVRAVDNGSPSKESVVLVYVKILPPEMQLPKFSEPFYTFTVSEDVPIGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSKPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 3072 - protein, 303 aa, Homo sapiens
MSDNGVCVLAFKCPGLLRYTAYRCKQLSDTSIIAVASHCPLLQKVHVGNQDKLTDEGLKQLGSKCRELKDIHFGQCYKISDEGMIVIAKGCLKLQRIYMQENKLVTDQSVKAFAEHCPELQYVGFMGCSVTSKGVIHLTKLRNLSSLDLRHITELDNETVMEIVKRCKNLSSLNLCLNWIINDRCVEVIAKEGQNLKELYLVSCKITDYALIAIGRYSMTIETVDVGWCKEITDQGATLIAQSSKSLRYLGLMRCDKVNEVTVEQLVQQYPHITFSTVLQDCKRTLERAYQMGWTPNMSAASS

SEQ ID NO: 3073 - protein, 423 aa, Homo sapiens
MVFSNNDEGLINKKLPKELLLRIFSFLDIVTLCRCAQISKAWNILALDGSNWQRIDLFNFQIDVEGRVVENISKRCGGFLRKLSLRGCIGVGDSSLKTFAQNCRNIEHLNLNGCTKITDSTCYSLSRFCSKLKHLDLTSCVSITNSSLKGISEGCRNLEYLNLSWCDQITKDGIEALVRGCRGLKALLLRGCTQLEDEALKHIQNYCHELVSLNLQSCSRITDEGVVQICRGCHRLQALCLSGCSNLTDASLTALGLNCPRLQILEAARCSHLTDAGFTLLARNCHELEKMDLEECILITDSTLIQLSIHCPKLQALSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 3074 - protein, 471 aa, Homo sapiens
MAAMETETAPLTLESLPTDPLLLILSFLDYRDLINCCYVSRRLSQLSSHDPLWRRHCKKYWLISEEEKTQKNQCWKSLFIDTYSDVGRYIDHYAAIKKAWDDLKKYLEPRCPRMVLSLKEGAREEDLDAVEAQIGCKLPDDYRCSYRIHNGQKLVVPGLLGSMALSNHYRSEDLLDVDTAAGGFQQRQGLKYCLPLTFCIHTGLSQYIAVEAAEGRNKNEVFYQCPDQMARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLEMGPDEYEEMEEEEEEEEEEDEDDDSADMDESDEDDEEERRRRVFDVPIRRRRCSRLF

SEQ ID NO: 3075 - protein, 415 aa, Homo sapiens
MAAMETETAPLTLESLPTDPLLLILSFLDYRDLINCCYVSRRLSQLSSHDPLWRRHCKKYWLISEEEKTQKNQCWKSLFIDTYSDVGRYIDHYAAIKKAWDDLKKYLEPRCPRMVLSLKEGAREEDLDAVEAQIGCKLPDDYRCSYRIHNGQKLVVPGLLGSMALSNHYRSEDLLDVDTAAGGFQQRQGLKYCLPLTFCIHTGLSQYIAVEAAEGRNKNEVFYQCPDQMARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLVS

SEQ ID NO: 3076 - protein, 452 aa, Homo sapiens
MDGTIKEALSVVSDDQSLFDSAYGAAAHLPKADMTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 3077 - protein, 376 aa, Homo sapiens
MADSRRVIIASWYRTFMGIVNLFGLETKTCWNVTRIEPLNEVQSCEGLRDPACFYVGVIFILNGLMMGLFFIYGTYLSGTELGGLITVLCFFFNHGEATCVMWTPPLRESFSYPFLVLQMYVLTLILRTSSNDRRPFIALCLSNVAFMLPWQFAQFILFTQIASLFPMYVVGYIEPSKFQKIIYMNMISVTLSFILMFGNSMYLSSYYSSSLLMTWAIILKRNEIQKLGVSKLNCWLIQGSAWWCGTIILKFLTSKILGVSDHICLSDLIAAGILRYTDFDTLKYTCSPEFDFMEKATLLIYTKTLLLPVVMVITCFIFKKTVGDISRVLATNVYLRCCLCRCHAYNGKCQAVYTSSHCESSTLRRCRLEAWLQHA

SEQ ID NO: 3078 - protein, 558 aa, Homo sapiens
MAKKVAVIGAGVSGLSSIKCCVDEDLEPTCFERSDDIGGLWKFTESSKDGMTRVYKSLVTNVCKEMSCYSDFPFHEDYPNFMNHEKFWDYLQEFAEHFDLLKYIQFKTTVCSITKRPDFSETGQWDVVTETEGKQNRAVFDAVMVCTGHFLNPHLPLEAFPGIHKFKGQILHSQEYKIPEGFQGKRVLVIGLGNTGGDIAVELSRTAAQVLLSTRTGTWVLGRSSDWGYPYNMMVTRRCCSFIAQVLPSRFLNWIQERKLNKRFNHEDYGLSITKGKKAKFIVNDELPNCILCGAITMKTSVIEFTETSAVFEDGTVEENIDVVIFTTGYTFSFPFFEEPLKSLCTKKIFLYKQVFPLNLERATLAIIGLIGLKGSILSGTELQARWVTRVFKGLCKIPPSQKLMMEATEKEQLIKRGVFKDTSKDKFDYIAYMDDIAACIGTKPSIPLLFLKDPRLAWEVFFGPCTPYQYRLMGPGKWDGARNAILTQWDRTLKPLKTRIVPDSSKPASMSHYLKAWGAPVLLASLLLICKSSLFLKLVRDKLQDRMSPYLVSLWRG

SEQ ID NO: 3079 - protein, 3012 aa, Homo sapiens
MASQQDSGFFEISIKYLLKSWSNTSPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKSKSDEQQRDYLMERRDLAIDFIFSLVLIEVLKQIPLHPVIDSLIHDVINLAFKHFKYKEGYLGPNTGNMHIVADLYAEVIGVLAQAKFPAVKKKFMAELKELRHKEQNPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHIFLNNCLSNLKNKDPKMARVALESLYRLLWVYMIRIKCESNTATQSRLITIITTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVDNILRHLDKEVGRCMMLTNVQMLNKEPEDMITGERKPKIDLFRTCVAAIPRLLPDGMSKLELIDLLARLSIHMDDELRHIAQNSLQGLLVDFSDWREDVLFGFTNFLLREVNDMHHTLLDSSLKLLLQLLTQWKLVIQTQGKVYEQANKIRNSELIANGSSHRIQSERGPHCSVLHAVEGFALVLLCSFQVATRKLSVLILKEIRALFIALGQPEDDDRPMIDVMDQLSSSILESFIHVAVSDSATLPLTHNVDLQWLVEWNAVLVNSHYDVKSPSHVWIFAQSVKDPWVLCLFSFLRQENLPKHCPTALSYAWPYAFTRLQSVMPLVDPNSPINAKKTSTAGSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSGKPAIPHNTPQRAPDHAYLPAALAAQHRAGGQQAPPPGSSPSSPEDEVKDREGDVTASHGLRGNGWGSPEATSLVLNNLMYMTAKYGDEVPGPEMENAWNALANNEKWSNNLRITLQFLISLCGVSSDTVLLPYIKKVAIYLCRNNTIQTMEELLFELQQTEPVNPIVQHCDNPPFYRFTASSKASAAASGTTSSSNTVVAGQENFPDAEENKILKESDERFSNVIRAHTRLESRYSNSSGGSYDEDKNDPISPYTGWLLTITETKQPQPLPMPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQSVHWREALNILKLVVSRSASLVLPSYQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 3080 - protein, 462 aa, Homo sapiens
MDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTPNKLLRLEDDGTLLYTMRLTISAECPMQLEDFPMDAHACPLKFGSYAYPNSEVVYVWTNGSTKSVVVAEDGSRLNQYHLMGQTVGTENISTSTGEYTIMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKKALEAAKIKKKREVILNKSTNAFTTGKMSHPPNIPKEQTPAGTSNTTSVSVKPSEEKTSESKKTYNSISKIDKMSRIVFPVLFGTFNLVYWATYLNREPVIKGAASPK

SEQ ID NO: 3081 - protein, 585 aa, Homo sapiens
MASPGSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGHPRYFNQLSTGLDMVGLAADWLTSTANTNMFTYEIAPVFVLLEYVTLKKMREIIGWPGGSGDGIFSPGGAISNMYAMMIARFKMFPEVKEKGMAALPRLIAFTSEHSHFSLKKGAAALGIGTDSVILIKCDERGKMIPSDLERRILEAKQKGFVPFLVSATAGTTVYGAFDPLLAVADICKKYKIWMHVDAAWGGGLLMSRKHKWKLSGVERANSVTWNPHKMMGVPLQCSALLVREEGLMQNCNQMHASYLFQQDKHYDLSYDTGDKALQCGRHVDVFKLWLMWRAKGTTGFEAHVDKCLELAEYLYNIIKNREGYEMVFDGKPQHTNVCFWYIPPSLRTLEDNEERMSRLSKVAPVIKARMMEYGTTMVSYQPLGDKVNFFRMVISNPAATHQDIDFLIEEIERLGQDL

SEQ ID NO: 3082 - protein, 944 aa, Homo sapiens
MAAVAAVAARRRRSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 3083 - protein, 966 aa, Homo sapiens
MAAVAAVAARRRRSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSFSDKVNLTLGSIWDKIKNLFSRQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 3084 - protein, 698 aa, Homo sapiens
MPSEGRCWETLKALRSSDKGRLCYYRDWLLRREDVLEECMSLPKLSSYSGWVVEHVLPHMQENQPLSETSPSSTSASALDQPSFVPKSPDASSAFSPASPATPNGTKGKDESQHTESMVLQSSRGIKVEGCVRMYELVHRMKGTEGLRLWQEEQERKVQALSEMASEQLKRFDEWKELKQHKEFQDLREVMEKSSREALGHQEKLKAEHRHRAKILNLKLREAEQQRVKQAEQERLRKEEGQIRLRALYALQEEMLQLSQQLDASEQHKALLKVDLAAFQTRGNQLCSLISGIIRASSESSYPTAESQAEAERALREMRDLLMNLGQEITRACEDKRRQDEEEAQVKLQEAQMQQGPEAHKEPPAPSQGPGGKQNEDLQVKVQDITMQWYQQLQDASMQCVLTFEGLTNSKDSQAKKIKMDLQKAATIPVSQISTIAGSKLKEIFDKIHSLLSGKPVQSGGRSVSVTLNPQGLDFVQYKLAEKFVKQGEEEVASHHEAAFPIAVVASGIWELHPRVGDLILAHLHKKCPYSVPFYPTFKEGMALEDYQRMLGYQVKDSKVEQQDNFLKRMSGMIRLYAAIIQLRWPYGNRQEIHPHGLNHGWRWLAQILNMEPLSDVTATLLFDFLEVCGNALMKQYQVQFWKMLILIKEDYFPRIEAITSSGQMGSFIRLKQFLEKCLQHKDIPVPKGFLTSSFWRS

SEQ ID NO: 3085 - protein, 659 aa, Homo sapiens
MPSEGRCWETLKALRSSDKGRLCYYRDWLLRREDVLEECMSLPKLSSYSGWVVEHVLPHMQENQPLSETSPSSTSASALDQPSFVPKSPDASSAFSPASPATPNGTKGKDESQHTESMVLQSSRGIKVEGCVRMYELVHRMKGTEGLRLWQEEQERKVQALSEMASEQLKRFDEWKELKQHKEFQDLREVMEKSSREALGHQEKLKAEHRHRAKILNLKLREAEQQRVKQAEQERLRKEEGQIRLRALYALQEEMLQLSQQLDASEQHKALLKVDLAAFQTRGNQLCSLISGIIRASSESSYPTAESQAEAERALREMRDLLMNLGQEITRACEDKRRQDEEEAQVKLQEAQMQQGPEAHKEPPAPSQGPGGKQNEDLQVKVQDITMQWYQQLQDASMQCVLTFEGLTNSKDSQAKKIKMDLQKAATIPVSQISTIAGSKLKEIFDKIHSLLSGKPVQSGGRSVSVTLNPQGLDFVQYKLAEKFVKQGEEEVASHHEAAFPIAVVASGIWELHPRVGDLILAHLHKKCPYSVPFYPTFKEGMALEDYQRMLGYQVKDSKVEQQDNFLKRMSGMIRLYAAIIQLRWPYGNRQEIHPHGLNHGWRWLAQILNMEPLSDVTATLLFDFLEVCGNALMKQYQVQFWKMLILIKEDYFPRYQAC

SEQ ID NO: 3086 - protein, 354 aa, Homo sapiens
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLMLFDSICNNKFFIDTSIILFLNKKDLFGEKIKKSPLTICFPEYTGPNTYEDAAAYIQAQFESKNRSPNKEIYCHMTCATDTNNIQVVFDAVTDIIIANNLRGCGLY

SEQ ID NO: 3087 - protein, 354 aa, Homo sapiens
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLKLFDSICNNKWFTDTSIILFLNKKDIFEEKIKKSPLTICFPEYTGPSAFTEAVAYIQAQYESKNKSAHKEIYSHVTCATDTNNIQFVFDAVTDVIIAKNLRGCGLY

SEQ ID NO: 3088 - protein, 359 aa, Homo sapiens
MTLESIMACCLSEEAKEARRINDEIERQLRRDKRDARRELKLLLLGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPAYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 3089 - protein, 353 aa, Homo sapiens
MATEGLHENETLASLKSEAESLKGKLEEERAKLHDVELHQVAERVEALGQFVMKTRRTLKGHGNKVLCMDWCKDKRRIVSSSQDGKVIVWDSFTTNKEHAVTMPCTWVMACAYAPSGCAIACGGLDNKCSVYPLTFDKNENMAAKKKSVAMHTNYLSACSFTNSDMQILTASGDGTCALWDVESGQLLQSFHGHGADVLCLDLAPSETGNTFVSGGCDKKAMVWDMRSGQCVQAFETHESDINSVRYYPSGDAFASGSDDATCRLYDLRADREVAIYSKESIIFGASSVDFSLSGRLLFAGYNDYTINVWDVLKGSRVSILFGHENRVSTLRVSPDGTAFCSGSWDHTLRVWA

SEQ ID NO: 3090 - protein, 395 aa, Homo sapiens
MCDQTFLVNVFGSCDKCFKQRALRPVFKKSQQLSYCSTCAEIMATEGLHENETLASLKSEAESLKGKLEEERAKLHDVELHQVAERVEALGQFVMKTRRTLKGHGNKVLCMDWCKDKRRIVSSSQDGKVIVWDSFTTNKEHAVTMPCTWVMACAYAPSGCAIACGGLDNKCSVYPLTFDKNENMAAKKKSVAMHTNYLSACSFTNSDMQILTASGDGTCALWDVESGQLLQSFHGHGADVLCLDLAPSETGNTFVSGGCDKKAMVWDMRSGQCVQAFETHESDINSVRYYPSGDAFASGSDDATCRLYDLRADREVAIYSKESIIFGASSVDFSLSGRLLFAGYNDYTINVWDVLKGSRVSILFGHENRVSTLRVSPDGTAFCSGSWDHTLRVWA

SEQ ID NO: 3091 - protein, 736 aa, Homo sapiens
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 3092 - protein, 769 aa, Homo sapiens
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKKHPFYTSPAVVMAHGEQPIPGLINYSHHSTDERIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 3093 - protein, 481 aa, Homo sapiens
MRWLWPLAVSLAVILAVGLSRVSGGAPLHLGRHRAETQEQQSRSKRGTEDEEAKGVQQYVPEEWAEYPRPIHPAGLQPTKPLVATSPNPGRDGGTPDSGQELRGNLTGAPGQRLQIQNPLYPVTESSYSAYAIMLLALVVFAVGIVGNLSVMCIVWHSYYLKSAWNSILASLALWDFLVLFFCLPIVIFNEITKQRLLGDVSCRAVPFMEVSSLGVTTFSLCALGIDRFHVATSTLPKVRPIERCQSILAKLAVIWVGSMTLAVPELLLWQLAQEPAPTMGTLDSCIMKPSASLPESLYSLVMTYQNARMWWYFGCYFCLPILFTVTCQLVTWRVRGPPGRKSECRASKHEQCESQLNSTVVGLTVVYAFCTLPENVCNIVVAYLSTELTRQTLDLLGLINQFSTFFKGAITPVLLLCICRPLGQAFLDCCCCCCCEECGGASEASAANGSDNKLKTEVSSSIYFHKPRESPPLLPLGTPC

SEQ ID NO: 3094 - protein, 451 aa, Homo sapiens
MESSPIPQSSGNSSTLGRVPQTPGPSTASGVPEVGLRDVASESVALFFMLLLDLTAVAGNAAVMAVIAKTPALRKFVFVFHLCLVDLLAALTLMPLAMLSSSALFDHALFGEVACRLYLFLSVCFVSLAILSVSAINVERYYYVVHPMRYEVRMTLGLVASVLVGVWVKALAMASVPVLGRVSWEEGAPSVPPGCSLQWSHSAYCQLFVVVFAVLYFLLPLLLILVVYCSMFRVARVAAMQHGPLPTWMETPRQRSESLSSRSTMVTSSGAPQTTPHRTFGGGKAAVVLLAVGGQFLLCWLPYFSFHLYVALSAQPISTGQVESVVTWIGYFCFTSNPFFYGCLNRQIRGELSKQFVCFFKPAPEEELRLPSREGSIEENFLQFLQGTGCPSESWVSRPLPSPKQEPPAVDFRIPGQIAEETSEFLEQQLTSDIIMSDSYLRPAASPRLES

SEQ ID NO: 3095 - protein, 902 aa, Homo sapiens
MRIISRQIVLLFSGFWGLAMGAFPSSVQIGGLFIRNTDQEYTAFRLAIFLHNTAPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVTKLMDRWKKLDQREYPGSETPPKYTSALTYDGVLVMAETFRSLRRQKIDISRRGKSGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMESPYVMYKKNHEMFEGNDKYEGYCVDLASEIAKHIGIKYKIAIVPDGKYGARDADTKIWNGMVGELVYGKAEIAIAPLTITLVREEVIDFSKPFMSLGISIMIKKPQKSKPGVFSFLDPLAYEIWMCIVFAYIGVSVVLFLVSRFSPYEWHTEEPEDGKEGPSDQPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWTYMRSAEPSVFTRTTAEGVARVRKSKGKFAFLLESTMNDNIEQRKPCDTMKVGGNLDSKGYGVATPKGSSLRTPVNLAVLKLSEAGVLDKLKNKWWYDKGECGPKDSGSKDKTSALSLSNVAGVFYILVGGLGLAMLVALIEFCYKSRAEAKRMKLTFSEAIRNKARLSITGSVGENGRVLTPDCPKAVHTGTAIRQSSGLAVIASDLP

SEQ ID NO: 3096 - protein, 395 aa, Homo sapiens
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKKAVDMTCHGEPSLYNSLSIAMQTLKHMPGHTSREVLIIFSSLTTCDPSNIYDLIKTLKAAKIRVSVIGLSAEVRVCTVLARETGGTYHVILDESHYKELLTHHVSPPPASSSSECSLIRMGFPQHTIASLSDQDAKPSFSMAHLDGNTEPGLTLGGYFCPQCRAKYCELPVECKICGLTLVSAPHLARSYHHLFPLDAFQEIPLEEYNGERFCYGCQGELKDQHVYVCAVCQNVFCVDCDVFVHDSLHCCPGCIHKIPAPSGV

SEQ ID NO: 3097 - protein, 203 aa, Homo sapiens
MARPRPREYKAGDLVFAKMKGYPHWPARIDELPEGAVKPPANKYPIFFFGTHETAFLGPKDLFPYKEYKDKFGKSNKRKGFNEGLWEIENNPGVKFTGYQAIQQQSSSETEGEGGNTADASSEEEGDRVEEDGKGKRKNEKAGSKRKKSYTSKKSSKQSRKSPGDEDDKDCKEEENKSSSEGGDAGNDTRNTTSDLQKTSEGT

SEQ ID NO: 3098 - protein, 4834 aa, Homo sapiens
MPSESFCLAAQARLDSKWLKTDIQLAFTRDGLCGLWNEMVKDGEIVYTGTESTQNGELPPRKDDSVEPSGTKKEDLNDKEKKDEEETPAPIYRAKSILDSWVWGKQPDVNELKECLSVLVKEQQALAVQSATTTLSALRLKQRLVILERYFIALNRTVFQENVKVKWKSSGISLPPVDKKSSRPAGKGVEGLARVGSRAALSFAFAFLRRAWRSGEDADLCSELLQESLDALRALPEASLFDESTVSSVWLEVVERATRFLRSVVTGDVHGTPATKGPGSIPLQDQHLALAILLELAVQRGTLSQMLSAILLLLQLWDSGAQETDNERSAQGTSAPLLPLLQRFQSIICRKDAPHSEGDMHLLSGPLSPNESFLRYLTLPQDNELAIDLRQTAVVVMAHLDRLATPCMPPLCSSPTSHKGSLQEVIGWGLIGWKYYANVIGPIQCEGLANLGVTQIACAEKRFLILSRNGRVYTQAYNSDTLAPQLVQGLASRNIVKIAAHSDGHHYLALAATGEVYSWGCGDGGRLGHGDTVPLEEPKVISAFSGKQAGKHVVHIACGSTYSAAITAEGELYTWGRGNYGRLGHGSSEDEAIPMLVAGLKGLKVIDVACGSGDAQTLAVTENGQVWSWGDGDYGKLGRGGSDGCKTPKLIEKLQDLDVVKVRCGSQFSIALTKDGQVYSWGKGDNQRLGHGTEEHVRYPKLLEGLQGKKVIDVAAGSTHCLALTEDSEVHSWGSNDQCQHFDTLRVTKPEPAALPGLDTKHIVGIACGPAQSFAWSSCSEWSIGLRVPFVVDICSMTFEQLDLLLRQVSEGMDGSADWPPPQEKECVAVATLNLLRLQLHAAISHQVDPEFLGLGLGSILLNSLKQTVVTLASSAGVLSTVQSAAQAVLQSGWSVLLPTAEERARALSALLPCAVSGNEVNISPGRRFMIDLLVGSLMADGGLESALHAAITAEIQDIEAKKEAQKEKEIDEQEANASTFHRSRTPLDKDLINTGICESSGKQCLPLVQLIQQLLRNIASQTVARLKDVARRISSCLDFEQHSRERSASLDLLLRFQRLLISKLYPGESIGQTSDISSPELMGVGSLLKKYTALLCTHIGDILPVAASIASTSWRHFAEVAYIVEGDFTGVLLPELVVSIVLLLSKNADLMQEAGAVPLLGGLLEHLDRFNHLAPGKERDDHEELAWPGIMESFFTGQNCRNNEEVTLIRKADLENHNKDGGFWTVIDGKVYDIKDFQTQSLTGNSILAQFAGEDPVVALEAALQFEDTRESMHAFCVGQYLEPDQEIVTIPDLGSLSSPLIDTERNLGLLLGLHASYLAMSTPLSPVEIECAKWLQSSIFSGGLQTSQIHYRYNEEKDEDHCSSPGGTPASKSRLCSHRRALGDHSQAFLQAIADNNIQDHNVKDFLCQIERYCRQCHLTTPIMFPPEHPVEEVGRLLLCCLLKHEDLGHVALSLVHAGALGIEQVKHRTLPKSVVDVCRVVYQAKCSLIKTHQEQGRSYKEVCAPVIERLRFLFNELRPAVCNDLSIMSKFKLLSSLPRWRRIAQKIIRERRKKRVPKKPESMDDEEKIGNEESDLEEACILPHSPINVDKRPIAIKSPKDKWQPLLSTVTGVHKYKWLKQNVQGLYPQSPLLSTIAEFALKEEPVDVEKMRKCLLKQLERAEVRLEGIDTILKLASKNFLLPSVQYAMFCGWQRLIPEGIDIGEPLTDCLKDVDLIPPFNRMLLEVTFGKLYAWAVQNIRNVLMDASAKFKELGIQPVPLQTITNENPSGPSLGTIPQARFLLVMLSMLTLQHGANNLDLLLNSGMLALTQTALRLIGPSCDNVEEDMNASAQGASATVLEETRKETAPVQLPVSGPELAAMMKIGTRVMRGVDWKWGDQDGPPPGLGRVIGELGEDGWIRVQWDTGSTNSYRMGKEGKYDLKLAELPAAAQPSAEDSDTEDDSEAEQTERNIHPTAMMFTSTINLLQTLCLSAGVHAEIMQSEATKTLCGLLRMLVESGTTDKTSSPNRLVYREQHRSWCTLGFVRSIALTPQVCGALSSPQWITLLMKVVEGHAPFTATSLQRQILAVHLLQAVLPSWDKTERARDMKCLVEKLFDFLGSLLTTCSSDVPLLRESTLRRRRVRPQASLTATHSSTLAEEVVALLRTLHSLTQWNGLINKYINSQLRSITHSFVGRPSEGAQLEDYFPDSENPEVGGLMAVLAVIGGIDGRLRLGGQVMHDEFGEGTVTRITPKGKITVQFSDMRTCRVCPLNQLKPLPAVAFNVNNLPFTEPMLSVWAQLVNLAGSKLEKHKIKKSTKQAFAGQVDLDLLRCQQLKLYILKAGRALLSHQDKLRQILSQPAVQETGTVHTDDGAVVSPDLGDMSPEGPQPPMILLQQLLASATQPSPVKAIFDKQELEAAALAVCQCLAVESTHPSSPGFEDCSSSEATTPVAVQHIRPARVKRRKQSPVPALPIVVQLMEMGFSRRNIEFALKSLTGASGNASSLPGVEALVGWLLDHSDIQVTELSDADTVSDEYSDEEVVEDVDDAAYSMSTGAVVTESQTYKKRADFLSNDDYAVYVRENIQVGMMVRCCRAYEEVCEGDVGKVIKLDRDGLHDLNVQCDWQQKGGTYWVRYIHVELIGYPPPSSSSHIKIGDKVRVKASVTTPKYKWGSVTHQSVGVVKAFSANGKDIIVDFPQQSHWTGLLSEMELVPSIHPGVTCDGCQMFPINGSRFKCRNCDDFDFCETCFKTKKHNTRHTFGRINEPGQSAVFCGRSGKQLKRCHSSQPGMLLDSWSRMVKSLNVSSSVNQASRLIDGSEPCWQSSGSQGKHWIRLEIFPDVLVHRLKMIVDPADSSYMPSLVVVSGGNSLNNLIELKTININPSDTTVPLLNDCTEYHRYIEIAIKQCRSSGIDCKIHGLILLGRIRAEEEDLAAVPFLASDNEEEEDEKGNSGSLIRKKAAGLESAATIRTKVFVWGLNDKDQLGGLKGSKIKVPSFSETLSALNVVQVAGGSKSLFAVTVEGKVYACGEATNGRLGLGISSGTVPIPRQITALSSYVVKKVAVHSGGRHATALTVDGKVFSWGEGDDGKLGHFSRMNCDKPRLIEALKTKRIRDIACGSSHSAALTSSGELYTWGLGEYGRLGHGDNTTQLKPKMVKVLLGHRVIQVACGSRDAQTLALTDEGLVFSWGDGDFGKLGRGGSEGCNIPQNIERLNGQGVCQIECGAQFSLALTKSGVVWTWGKGDYFRLGHGSDVHVRKPQVVEGLRGKKIVHVAVGALHCLAVTDSGQVYAWGDNDHGQQGNGTTTVNRKPTLVQGLEGQKITRVACGSSHSVAWTTVDVATPSVHEPVLFQTARDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGRLSSQPVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLAASLAACAQLSALAASHRMWALQRLRKLLTTEFGQSININRLLGENDGETRALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIESLRGIEVVDVAAGGAHSACVTAAGDLYTWGKGRYGRLGHSDSEDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVVQATMVRDRQHGPVVELNRIQVKRSRSKGGLAGPDGTKSVFGQMCAKMSSFGPDSLLLPHRVWKVKFVGESVDDCGGGYSESIAEICEELQNGLTPLLIVTPNGRDESGANRDCYLLSPAARAPVHSSMFRFLGVLLGIAIRTGSPLSLNLAEPVWKQLAGMSLTIADLSEVDKDFIPGLMYIRDNEATSEEFEAMSLPFTVPSASGQDIQLSSKHTHITLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 3099 - protein, 728 aa, Homo sapiens
MEETQPPPQPKLPLCDSLMIWLQTFNTASPCQDVKQLTSGVAMAQVLHQIDAAWFNESWLSRIKEDVGDNWRIKASNVKKVLQGIMSYYHEFLGQQISEALIPDLNQITECSDPVELGRLLQLILGCAINCEKKQEHIQNIMTLEESVQHVVMTAIQELMSKEILSSPPNDAVGELEQQLKRALEELQEALAEKEELRQRCEELDMQVTTLQDEKNSLVSENEMMNEKLDQLDGSFDDPNTVVAKKYFHAQLQLEQLQEENFRLEAAKDDYRVHCEELEKQLIEFQHRNDELTSLAEETRALKDEIDVLRATSDKANKLESTVEIYRQKLQDLNDLRKQVKTLQETNMMYMHNTVSLEEELKKANAARTQLETYKRQVQDLHVKLSSESKRADTLAFEMKRLEEKHEALLKEKERLIEQRDTLKETNEELRCSQVQQDHLNQTDASATKSYENLAAEIMPVEYREVFIRLQHENKMLRLQQEGSENERIEELQEQLEQKHRKMNELETEQRLSKERIRELQQQIEDLQKSLQEQGSKSEGESSSKLKQKLEAHMEKLTEVHEELQKKQELIEDLQPDINQNVQKINELEAALQKKDEDMKAMEERYKMYLEKARNVIKTLDPKLNPASAEIMLLRKQLAEKERRIEILESECKVAKFRDYEEKLIVSAWYNKSLAFQKLGMESRLVSGGGACSDTGACTPARSFLAQQRHITNTRRNLSVKVPATTSD

SEQ ID NO: 3100 - protein, 366 aa, Homo sapiens
MDFLNSSDQNLTSEELLNRMPSKILVSLTLSGLALMTTTINSLVIAAIIVTRKLHHPANYLICSLAVTDFLVAVLVMPFSIVYIVRESWIMGQVVCDIWLSVDITCCTCSILHLSAIALDRYRAITDAVEYARKRTPKHAGIMITIVWIISVFISMPPLFWRHQGTSRDDECIIKHDHIVSTIYSTFGAFYIPLALILILYYKIYRAAKTLYHKRQASRIAKEEVNGQVLLESGEKSTKSVSTSYVLEKSLSDPSTDFDKIHSTVRSLRSEFKHEKSWRRQKISGTRERKAATTLGLILGAFVICWLPFFVKELVVNVCDKCKISEEMSNFLAWLGYLNSLINPLIYTIFNEDFKKAFQKLVRCRC

SEQ ID NO: 3101 - protein, 471 aa, Homo sapiens
MDILCEENTSLSSTTNSLMQLNDDTRLYSNDFNSGEANTSDAFNWTVDSENRTNLSCEGCLSPSCLSLLHLQEKNWSALLTAVVIILTIAGNILVIMAVSLEKKLQNATNYFLMSLAIADMLLGFLVMPVSMLTILYGYRWPLPSKLCAVWIYLDVLFSTASIMHLCAISLDRYVAIQNPIHHSRFNSRTKAFLKIIAVWTISVGISMPIPVFGLQDDSKVFKEGSCLLADDNFVLIGSFVSFFIPLTIMVITYFLTIKSLQKEATLCVSDLGTRAKLASFSFLPQSSLSSEKLFQRSIHREPGSYTGRRTMQSISNEQKACKVLGIVFFLFVVMWCPFFITNIMAVICKESCNEDVIGALLNVFVWIGYLSSAVNPLVYTLFNKTYRSAFSRYIQCQYKENKKPLQLILVNTIPALAYKSSQLQMGQKKNSKQDAKTTDNDCSMVALGKQHSEEASKDNSDGVNEKVSCV

SEQ ID NO: 3102 - protein, 714 aa, Homo sapiens
MPAAAGDGLLGEPAAPGGGGGAEDAARPAAACEGSFLPAWVSGVPRERLRDFQHHKRVGNYLIGSRKLGEGSFAKVREGLHVLTGEKVAIKVIDKKRAKKDTYVTKNLRREGQIQQMIRHPNITQLLDILETENSYYLVMELCPGGNLMHKIYEKKRLEESEARRYIRQLISAVEHLHRAGVVHRDLKIENLLLDEDNNIKLIDFGLSNCAGILGYSDPFSTQCGSPAYAAPELLARKKYGPKIDVWSIGVNMYAMLTGTLPFTVEPFSLRALYQKMVDKEMNPLPTQLSTGAISFLRSLLEPDPVKRPNIQQALANRWLNENYTGKVPCNVTYPNRISLEDLSPSVVLHMTEKLGYKNSDVINTVLSNRACHILAIYFLLNKKLERYLSGKSDIQDSLCYKTRLYQIEKYRAPKESYEASLDTWTRDLEFHAVQDKKPKEQEKRGDFLHRPFSKKLDKNLPSHKQPSGSLMTQIQNTKALLKDRKASKSSFPDKDSFGCRNIFRKTSDSNCVASSSMEFIPVPPPRTPRIVKKPEPHQPGPGSTGIPHKEDPLMLDMVRSFESVDRDDHVEVLSPSHHYRILNSPVSLARRNSSERTLSPGLPSGSMSPLHTPLHPTLVSFAHEDKNSPPKEEGLCCPPPVPSNGPMQPLGSPNCVKSRGRFPMMGIGQMLRKRHQSLQPSADRPLEASLPPLQPLAPVNLAFDMADGVKTQC

SEQ ID NO: 3103 - protein, 1313 aa, Homo sapiens
MSGWRYLICVSFLLTILLELTYQGPPVPASSSTKLLMTSYSMRSTVVSRYAHTLVTSVLFNPHAEAHEAIFDLDLPHLAFISNFTMTINNKVYIAEVKEKHQAKKIYEEAHQQGKTAAHVGIRDRESEKFRISTSLAAGTEVTFSLAYEELLQRHQGQYQLVVSLRPGQLVKRLSIEVTVSERTGISYVHIPPLRTGRLRTNAHASEVDSPPSTRIERGETCVRITYCPTLQDQSSISGSGIMADFLVQYDVVMEDIIGDVQIYDDYFIHYFAPRGLPPMEKNVVFVIDVSSSMFGTKMEQTKTAMNVILSDLQANDYFNIISFSDTVNVWKAGGSIQATIQNVHSAKDYLHCMEADGWTDVNSALLAAASVLNHSNQEPGRGPSVGRIPLIIFLTDGEPTAGVTTPSVILSNVRQALGHRVSLFSLAFGDDADFTLLRRLSLENRGIARRIYEDTDAALQLKGLYEEISMPLLADVRLNYLGGLVGASPWAVFPNYFGGSELVVAGQVQPGKQELGIHLAARGPKDQLLVAHHSEGATNNSQKAFGCPGEPAPNVAHFIRRLWAYVTIGELLDAHFQARDTTTRHLLAAKVLNLSLEYNFVTPLTSLVMVQPKQASEETRRQTSTSAGPDTIMPSSSSRHGLGVSTAQPALVPKVISPKSRPVKPKFYLSSTTTASTKKMLSSKELEPLGESPHTLSMPTYPKAKIPAQQDSGTLAQPTLRTKPTILVPSNSGTLLPLKPGSLSHQNPDILPTNSRTQVPPVKPGIPASPKADTVKCVTPLHSKPGAPSHPQLGALTSQAPKGLPQSRPGVSTLQVPKYPLHTRPRVPAPKTRNNMPHLGPGILLSKTPKILLSLKPSAPPHQISTSISLSKPETPNPHMPQTPLPPRPDRPRPPLPESLSTFPNTISSSTGPSSTTTTSVLGEPLPMPFTPTLPPGRFWHQYDLLPGPQRTRQVLGPSRPGVPTMSLLNSSRPTPEGSPPNLPILLPSSILPEAISLLLLPEELELLSESMVESKFVESLNPPAFYTFLTPDEDGSPNWDGNSEEILGGAGGSMESQGSSVGLAKGTLPSIFTFSSSVDGDPHFVIQIPHSEEKICFTLNGHPGDLLQLIEDPKAGLHVSGKLLGAPPRPGHKDQTRTYFQIITVTTDKPRAYTITISRSSISLRGEGTLRLSWDQPALLKRPQLELYVAAAARLTLRLGPYLEFLVLRHRYRHPSTLQLPHLGFYVANGSGLSPSARGLIGQFQHADIRLVTGPMGPCLRRHHGPDVPVILGKRLLKDSPRLLPRWASCWLVKRSHVELLLGHPYLSYVL

SEQ ID NO: 3104 - protein, 1096 aa, Homo sapiens
MGSEDHGAQNPSCKIMTFRPTMEEFKDFNKYVAYIESQGAHRAGLAKIIPPKEWKPRQTYDDIDDVVIPAPIQQVVTGQSGLFTQYNIQKKAMTVGEYRRLANSEKYCTPRHQDFDDLERKYWKNLTFVSPIYGADISGSLYDDDVAQWNIGSLRTILDMVERECGTIIEGVNTPYLYFGMWKTTFAWHTEDMDLYSINYLHFGEPKSWYAIPPEHGKRLERLAIGFFPGSSQGCDAFLRHKMTLISPIILKKYGIPFSRITQEAGEFMITFPYGYHAGFNHGFNCAESTNFATLRWIDYGKVATQCTCRKDMVKISMDVFVRILQPERYELWKQGKDLTVLDHTRPTALTSPELSSWSASRASLKAKLLRRSHRKRSQPKKPKPEDPKFPGEGTAGAALLEEAGGSVKEEAGPEVDPEEEEEEPQPLPHGREAEGAEEDGRGKLRPTKAKSERKKKSFGLLPPQLPPPPAHFPSEEALWLPSPLEPPVLGPGPAAMEESPLPAPLNVVPPEVPSEELEAKPRPIIPMLYVVPRPGKAAFNQEHVSCQQAFEHFAQKGPTWKEPVSPMELTGPEDGAASSGAGRMETKARAGEGQAPSTFSKLKMEIKKSRRHPLGRPPTRSPLSVVKQEASSDEEASPFSGEEDVSDPDALRPLLSLQWKNRAASFQAERKFNAAAARTEPYCAICTLFYPYCQALQTEKEAPIASLGEGCPATLPSKSRQKTRPLIPEMCFTSGGENTEPLPANSYIGDDGTSPLIACGKCCLQVHASCYGIRPELVNEGWTCSRCAAHAWTAECCLCNLRGGALQMTTDRRWIHVICAIAVPEARFLNVIERHPVDISAIPEQRWKLKCVYCRKRMKKVSGACIQCSYEHCSTSFHVTCAHAAGVLMEPDDWPYVVSITCLKHKSGGHAVQLLRAVSLGQVVITKNRNGLYYRCRVIGAASQTCYEVNFDDGSYSDNLYPESITSRDCVQLGPPSEGELVELRWTDGNLYKAKFISSVTSHIYQVEFEDGSQLTVKRGDIFTLEEELPKRVRSRLSLSTGAPQEPAFSGEEAKAAKRPRVGTPLATEDSGRSQDYVAFVESLLQVQGRPGAPF

SEQ ID NO: 3105 - protein, 628 aa, Homo sapiens
MSPGGKFDFDDGGCYVGGWEAGRAHGYGVCTGPGAQGEYSGCWAHGFESLGVFTGPGGHSYQGHWQQGKREGLGVERKSRWTYRGEWLGGLKGRSGVWESVSGLRYAGLWKDGFQDGYGTETYSDGGTYQGQWQAGKRHGYGVRQSVPYHQAALLRSPRRTSLDSGHSDPPTPPPPLPLPGDEGGSPASGSRGGFVLAGPGDADGASSRKRTPAAGGFFRRSLLLSGLRAGGRRSSLGSKRGSLRSEVSSEVGSTGPPGSEASGPPAAAPPALIEGSATEVYAGEWRADRRSGFGVSQRSNGLRYEGEWLGNQRHGYGRTTRPDGSREEGKYKRNRLVHGGRVRSLLPLALRRGKVKEKVDRAVEGARRAVSAARQRQEIAAARAADALLKAVAASSVAEKAVEAARMAKLIAQDLQPMLEAPGRRPRQDSEGSDTEPLDEDSPGVYENGLTPSEGSPELPSSPASSRQPWRPPACRSPLPPGGDQGPFSSPKAWPEEWGGAGAQAEELAGYEAEDEAGMQGPGPRDGSPLLGGCSDSSGSLREEEGEDEEPLPPLRAPAGTEPEPIAMLVLRGSSSRGHDAGCLTEELGEPAATERPAQPGAANPLVVGAVALLDLSLAFLFSQLLT

SEQ ID NO: 3106 - protein, 623 aa, Homo sapiens
MSTQDERQINTEYAVSLLEQLKLFYEQQLFTDIVLIVEGTEFPCHKMVLATCSSYFRAMFMSGLSESKQTHVHLRNVDAATLQIIITYAYTGNLAMNDSTVEQLYETACFLQVEDVLQRCREYLIKKINAENCVRLLSFADLFSCEELKQSAKRMVEHKFTAVYHKDAFMQLSHDLLIDILSSDNLNVEKEETVREAAMLWLEYNTESRSQYLSSVLSQIRIDALSEVTQRAWFQGLPPNDKSVVVQGLYKSMPKFFKPRLGMTKEEMMIFIEASSENPCSLYSSVCYSPQAEKVYKLCSPPADLHKVGTVVTPDNDIYIAGGQVPLKNTKTNHSKTSKLQTAFRTVNCFYWFDAQQNTWFPKTPMLFVRIKPSLVCCEGYIYAIGGDSVGGELNRRTVERYDTEKDEWTMVSPLPCAWQWSAAVVVHDCIYVMTLNLMYCYFPRSDSWVEMAMRQTSRSFASAAAFGDKIFYIGGLHIATNSGIRLPSGTVDGSSVTVEIYDVNKNEWKMAANIPAKRYSDPCVRAVVISNSLCVFMRETHLNERAKYVTYQYDLELDRWSLRQHISERVLWDLGRDFRCTVGKLYPSCLEEYPWKPPTYLFSTDGTEEFELDGEMVALPPV

SEQ ID NO: 3107 - protein, 872 aa, Homo sapiens
MGLKARRAAGAAGGGGDGGGGGGGAANPAGGDAAAAGDEERKVGLAPGDVEQVTLALGAGADKDGTLLLEGGGRDEGQRRTPQGIGLLAKTPLSRPVKRNNAKYRRIQTLIYDALERPRGWALLYHALVFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGSAFTFPSQQSPRNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSSWMREKRYLAEGETDTDTDPFTPSGSMPLSSTGDGISDSVWTPSNKPI

SEQ ID NO: 3108 - protein, 500 aa, Homo sapiens
MPSSGRALLDSPLDSGSLTSLDSSVFCSEGEGEPLALGDCFTVNVGGSRFVLSQQALSCFPHTRLGKLAVVVASYRRPGALAAVPSPLELCDDANPVDNEYFFDRSSQAFRYVLHYYRTGRLHVMEQLCALSFLQEIQYWGIDELSIDSCCRDRYFRRKELSETLDFKKDTEDQESQHESEQDFSQGPCPTVRQKLWNILEKPGSSTAARIFGVISIIFVVVSIINMALMSAELSWLDLQLLEILEYVCISWFTGEFVLRFLCVRDRCRFLRKVPNIIDLLAILPFYITLLVESLSGSQTTQELENVGRIVQVLRLLRALRMLKLGRHSTGLRSLGMTITQCYEEVGLLLLFLSVGISIFSTVEYFAEQSIPDTTFTSVPCAWWWATTSMTTVGYGDIRPDTTTGKIVAFMCILSGILVLALPIAIINDRFSACYFTLKLKEAAVRQREALKKLTKNIATDSYISVNLRDVYARSIMEMLRLKGRERASTRSSGGDDFWF

SEQ ID NO: 3109 - protein, 212 aa, Homo sapiens
MNLFRFLGDLSHLLAIILLLLKIWKSRSCAGISGKSQVLFAVVFTARYLDLFTNYISLYNTCMKVVYIACSFTTVWLIYSKFKATYDGNHDTFRVEFLVVPTAILAFLVNHDFTPLEILWTFSIYLESVAILPQLFMVSKTGEAETITSHYLFALGVYRTLYLFNWIWRYHFEGFFDLIAIVAGLVQTVLYCDFFYLYITKVLKGKKLSLPA

SEQ ID NO: 3110 - protein, 993 aa, Homo sapiens
MAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVQKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 3111 - protein, 788 aa, Homo sapiens
MDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKEVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 3112 - protein, 1424 aa, Homo sapiens
MESIQGLSSWCIENKKHHSTIVYHWMKWLRRSAYPHRLNLFYLANDVIQNCKRKNAIIFRESFADVLPEAAALVKDPSVSKSVERIFKIWEDRNVYPEEMIVALREALSTTFKTQKQLKENLNKQPNKQWKKSQTSTNPKAALKSKIVAEFRSQALIEELLLYKRSEDQIELKEKQLSTMRVDVCSTETLKCLKDKTGGKKFSKEFEEASSKLEEFVNGLDKQVKNGPSLTEALENAGIFYEAQYKEVKVVANAYKTFANRVNNLKKKLDQLKSTLPDPEESPVPSPSMDAPSPTGSESPFQGMGGEESQSPTMESEKSATPEPVTDNRDVEDMELSDVEDDGSKIIVEDRKEKPAEKSAVSTSVPTKPTENISKASSCTPVPVTMTATPPLPKPVNTSLSPSPALALPNLANVDLAKISSILSSLTSVMKNTGVSPASRPSPGTPTSPSNLTSGLKTPAPATTTSHNPLANILSKVEITPESILSALSKTQTQSAPALQGLSSLLQSVTGNPVPASEAASQSTSASPANTTVSTIKGRNLPSSAQPFIPKSFNYSPNSSTSEVSSTSASKASIGQSPGLPSTTFKLPSNSLGFTATHNTSPAAPPTEVTICQSSEVSKPKLESESTSPSLEMKIHNFLKGNPGFSGLNLNIPILSSLGSSAPSESHPSDFQRGPTSTSIDNIDGTPVRDERSGTPTQDEMMDKPTSSSVDTMSLLSKIISPGSSTPSSTRSPPPGRDESYPRELSNSVSTYRPFGLGSESPYKQPSDGMERPSSLMDSSQEKFYPDTSFQEDEDYRDFEYSGPPPSAMMNLEKKPAKSILKSSKLSDTTEYQPILSSYSHRAQEFGVKSAFPPSVRALLDSSENCDRLSSSPGLFGAFSVRGNEPGSDRSPSPSKNDSFFTPDSNHNSLSQSTTGHLSLPQKQYPDSPHPVPHRSLFSPQNTLAAPTGHPPTSGVEKVLASTISTTSTIEFKNMLKNASRKPSDDKHFGQAPSKGTPSDGVSLSNLTQPSLTATDQQQQEEHYRIETRVSSSCLDLPDSTEEKGAPIETLGYHSASNRRMSGEPIQTVESIRVPGKGNRGHGREASRVGWFDLSTSGSSFDNGPSSASELASLGGGGSGGLTGFKTAPYKERAPQFQESVGSFRSNSFNSTFEHHLPPSPLEHGTPFQREPVGPSSAPPVPPKDHGGIFSRDAPTHLPSVDLSNPFTKEAALAHAAPPPPPGEHSGIPFPTPPPPPPPGEHSSSGGSGVPFSTPPPPPPPVDHSGVVPFPAPPLAEHGVAGAVAVFPKDHSSLLQGTLAEHFGVLPGPRDHGGPTQRDLNGPGLSRVRESLTLPSHSLEHLGPPHGGGGGGGSNSSSGPPLGPSHRDTISRSGIILRSPRPDFRPREPFLSRDPFHSLKRPRPPFARGPPFFAPKRPFFPPRY

SEQ ID NO: 3113 - protein, 521 aa, Homo sapiens
MEASVLSPTSWEKRRAWLRQSRNWQTQVLEEEAAAALQDVPDPEPSSLDDVFQEGNPINKIEDWLQDCGYSEEGFSEEAGQFIYNGFCSHGTSFEDDLTLGAEATLLAANGKLFSRSFLETARPCQLLDLGCSLASSSMTGGTNKTSSSISEILDKVQEDAEDVLFSLGFGQEDHKDTSRIPARFFTTPSQAKGIDFQLFLKSQVRRIEMEDPCLMLASRFKQVQTLAVTADAFFCLYSYVSKTPVQKFTPSHMFWNCNHPTDVPSIRILSREPEPQSPRDRLRKAISKMCLYTCPRDRPPPPHNTPKRNSLDQVVLEVMDKVKEEKQFLQQDSDLGQFSQEDPVPPAEGKKLPTSPYPCVFCCEEETQQRMSTVLAPSQTLDSNPKVPCCTHSLPIEDPQWSTDPAQIRRELCSLPATNTETHPAKDETFWKRKSRARKSLFQKNLMGRKVKSLDLSITQQKWKQSVDRPELRRSLSQQPQDTFDLEEVQSNSEEEQSQSRWPSRPRHPHHHQTFAGKDS

SEQ ID NO: 3114 - protein, 383 aa, Homo sapiens
MTGGTNKTSSSISEILDKVQEDAEDVLFSLGFGQEDHKDTSRIPARFFTTPSQAKGIDFQLFLKSQVRRIEMEDPCLMLASRFKQVQTLAVTADAFFCLYSYVSKTPVQKFTPSHMFWNCNHPTDVPSIRILSREPEPQSPRDRLRKAISKMCLYTCPRDRPPPPHNTPKRNSLDQVVLEVMDKVKEEKQFLQQDSDLGQFSQEDPVPPAEGKKLPTSPYPCVFCCEEETQQRMSTVLAPSQTLDSNPKVPCCTHSLPIEDPQWSTDPAQIRRELCSLPATNTETHPAKDETFWKRKSRARKSLFQKNLMGRKVKSLDLSITQQKWKQSVDRPELRRSLSQQPQDTFDLEEVQSNSEEEQSQSRWPSRPRHPHHHQTFAGKDS

SEQ ID NO: 3115 - protein, 383 aa, Homo sapiens; identical to SEQ ID NO: 3114

SEQ ID NO: 3116 - protein, 383 aa, Homo sapiens; identical to SEQ ID NO: 3114

SEQ ID NO: 3117 - protein, 411 aa, Homo sapiens
MTGGTNKTSSSISEILDKVQEDAEDVLFSLGFGQEDHKDTSRIPARFFTTPSQAKGIDFQLFLKSQVRRIEMEDPCLMLASRFKQVQTLAVTADAFFCLYSYVSKTPVQKFTPSHMFWNCNHPTDVPSIRILSREPEPQSPRDRLRKAISKMCLYTCPRDRPPPPHNTPKRNSLDQVVLEVMDKVKEEKQFLQQDSDLGQFSQEDPVPPAEGKKLPTSPYPCVFCCEEETQQRMSTVLAPSQTLDSNPKVPCCTHSLPIEDPQWSTDPAQIRRELCSLPATNTETHPAKDETFWKRKSRARKSLFQKNLMGRKVKSLDLSITQQKWKQSVDRPELRRSLSQQPQDTFDLEEAFSTTTTACGLTELASKKKLKATSCRKLHCPQHPAPTPWSSKPPNSAGERQHGTWGGRPD

SEQ ID NO: 3118 - protein, 148 aa, Homo sapiens
MTGGTNKTSSSISEILDKVQEDAEDVLFSLGFGQEDHKDTSRIPARFFTTPSQAKGIDFQLFLKSQVRRIEMEDPCLMLASFLHHHNSMWSDRIGFKEETKSHLLQETALPSTSSPYSLVLQTPKLCRRKAAWYMGRKTRLSDLESTS

SEQ ID NO: 3119 - protein, 296 aa, Homo sapiens
MFWNCNHPTDVPSIRILSREPEPQSPRDRLRKAISKMCLYTCPRDRPPPPHNTPKRNSLDQVVLEVMDKVKEEKQFLQQDSDLGQFSQEDPVPPAEGKKLPTSPYPCVFCCEEETQQRMSTVLAPSQTLDSNPKVPCCTHSLPIEDPQWSTDPAQIRRELCSLPATNTETHPAKDETFWKRKSRARKSLFQKNLMGRKVKSLDLSITQQKWKQSVDRPELRRSLSQQPQDTFDLEEAFSTTTTACGLTELASKKKLKATSCRKLHCPQHPAPTPWSSKPPNSAGERQHGTWGGRPD

SEQ ID NO: 3120 - protein, 245 aa, Homo sapiens
MEASVLSPTSWEKRRAWLRQSRNWQTQVLEEEAAAALQDVPDPEPSSLDDVFQEGNPINKIEDWLQDCGYSEEGFSEEAGQFIYNGFCSHGTSFEDDLTLGAEATLLAANGKLFSRSFLETARPCQLLDLGCSLASSSMTGGTNKTSSSRCKHWLSLLMPSSVSTPMCLRHLSKSSHHPTCSGIATIQLMCHPSGFCPESLNPSHPETAFGKPSPRCVCTHAPETGHHHPTTPPKGTVWTKLCWK

SEQ ID NO: 3121 - protein, 81 aa, Homo sapiens
MEASVLSPTSWEKRRAWLRQSRNWQTQVLEEEAAAALQDVPDPEPSSLDDVFQEGNPINKIEDWLQDCGKLNTTDSHWKRI

SEQ ID NO: 3122 - protein, 296 aa, Homo sapiens; identical to SEQ ID NO: 3119

SEQ ID NO: 3123 - protein, 268 aa, Homo sapiens
MFWNCNHPTDVPSIRILSREPEPQSPRDRLRKAISKMCLYTCPRDRPPPPHNTPKRNSLDQVVLEVMDKVKEEKQFLQQDSDLGQFSQEDPVPPAEGKKLPTSPYPCVFCCEEETQQRMSTVLAPSQTLDSNPKVPCCTHSLPIEDPQWSTDPAQIRRELCSLPATNTETHPAKDETFWKRKSRARKSLFQKNLMGRKVKSLDLSITQQKWKQSVDRPELRRSLSQQPQDTFDLEEVQSNSEEEQSQSRWPSRPRHPHHHQTFAGKDS

SEQ ID NO: 3124 - protein, 521 aa, Homo sapiens; identical to SEQ ID NO: 3113

SEQ ID NO: 3125 - protein, 383 aa, Homo sapiens; identical to SEQ ID NO: 3114

SEQ ID NO: 3126 - protein, 383 aa, Homo sapiens; identical to SEQ ID NO: 3114

SEQ ID NO: 3127 - protein, 383 aa, Homo sapiens; identical to SEQ ID NO: 3114

SEQ ID NO: 3128 - protein, 411 aa, Homo sapiens; identical to SEQ ID NO: 3117

SEQ ID NO: 3129 - protein, 148 aa, Homo sapiens; identical to SEQ ID NO: 3118

SEQ ID NO: 3130 - protein, 296 aa, Homo sapiens; identical to SEQ ID NO: 3119

SEQ ID NO: 3131 - protein, 245 aa, Homo sapiens; identical to SEQ ID NO: 3120

SEQ ID NO: 3132 - protein, 81 aa, Homo sapiens; identical to SEQ ID NO: 3121

SEQ ID NO: 3133 - protein, 296 aa, Homo sapiens; identical to SEQ ID NO: 3119

SEQ ID NO: 3134 - protein, 268 aa, Homo sapiens; identical to SEQ ID NO: 3123

SEQ ID NO: 3135 - protein, 488 aa, Homo sapiens
MFLRKKYRGKDFGLHMLEDFVDSFTEDALGLRYPLSSLMYTACKQYFEKYPGDHELLWEVEGVGHWYQRIPVTRALQREALKILALSQNEPKRPMSGEYGPASVPEYEARTEDNQSSEMQLTIDSLKDAFASTSEGHDKTSVSTHTRSGNLKRPKIGKRFQDSEFSSSQGEDEKTSQTSLTASINKLESTARPSESSEEFLEEEPEQRGIEFEDESSDRDARPALETQPQQEKQDGEKESELEPMNGEIMDDSLKTSLITEEEDSTSEVLDEELKLQPFNSSEDSTNLVPLVVESSKPPEVDAPDKTPRIPDSEMLMDEGTSDEKGHMEEKLSLLPRKKAHLGSSDNVATMSNEERSDGGFPNSVIAEFSEEPVSENLSPNTTSSLEDQGEEGVSEPQETSTALPQSSLIEVELEDVPFSQNAGQKNQSEEQSEASSEQLDQFTQSAEKAVDSSSEEIEVEVPVVDRRNLRRKAKGHKGPAKKKAKLT

SEQ ID NO: 3136 - protein, 244 aa, Homo sapiens
MNGEIMDDSLKTSLITEEEDSTSEVLDEELKLQPFNSSEDSTNLVPLVVESSKPPEVDAPDKTPRIPDSEMLMDEGTSDEKGHMEEKLSLLPRKKAHLGSSDNVATMSNEERSDGGFPNSVIAEFSEEPVSENLSPNTTSSLEDQGEEGVSEPQETSTALPQSSLIEVELEDVPFSQNAGQKNQSEEQSEASSEQLDQFTQSAEKAVDSSSEEIEVEVPVVDRRNLRRKAKGHKGPAKKKAKLT

SEQ ID NO: 3137 - protein, 610 aa, Homo sapiens
MAFPVDMLENCSHEELENSAEDYMSDLRCGDPENPECFSLLNITIPISLSNVGFVPLYGGDQTQKILALFAPEDSLTAVALYLADQWWAIDDIVKTSVPSREGLKQVSTLGERVVLYVLNRIIYRKQEMERNEIPFLCHSSTDYAKILWKKGEAIGFYSVKPTACKQYFEKYPGDHELLWEVEGVGHWYQRIPVTRALQREALKILALSQNEPKRPMSGEYGPASVPEYEARTEDNQSSEMQLTIDSLKDAFASTSEGHDKTSVSTHTRSGNLKRPKIGKRFQDSEFSSSQGEDEKTSQTSLTASINKLESTARPSESSEEFLEEEPEQRGIEFEDESSDRDARPALETQPQQEKQDGEKESELEPMNGEIMDDSLKTSLITEEEDSTSEVLDEELKLQPFNSSEDSTNLVPLVVESSKPPEVDAPDKTPRIPDSEMLMDEGTSDEKGHMEEKLSLLPRKKAHLGSSDNVATMSNEERSDGGFPNSVIAEFSEEPVSENLSPNTTSSLEDQGEEGVSEPQETSTALPQSSLIEVELEDVPFSQNAGQKNQSEEQSEASSEQLDQFTQSAEKAVDSSSEEIEVEVPVVDRRNLRRKAKGHKGPAKKKAKLT

SEQ ID NO: 3138 - protein, 1771 aa, Homo sapiens
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRPFFAPYLYTPRYYPGGSQHLISRPSVKTSLPRDQNNGLEVIKEDAAEGLSSPTDSSRGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQSQTRRTPSLSSLNSQDSSIEISKLTDKVQAEYRDAYREYIAQMSQLEGGPGSTTISGRSSPHSTYYMGQSSSGGSIHSNLEQEKGKDSEPKPDDGRKSFLMKRGDVIDYSSSGVSTNDASPLDPITEEDEKSDQSGSKLLPGKKSSERSSLFQTDLKLKGSGLRYQKLPSDEDESGTEESDNTPLLKDDKDRKAEGKVERVPKSPEHSAEPIRTFIKAKEYLSDALLDKKDSSDSGVRSSESSPNHSLHNEVADDSQLEKANLIELEDDSHSGKRGIPHSLSGLQDPIIARMSICSEDKKSPSECSLIASSPEENWPACQKAYNLNRTPSTVTLNNNSAPANRANQNFDEMEGIRETSQVILRPSSSPNPTTIQNENLKSMTHKRSQRSSYTRLSKDPPELHAAASSESTGFGEERESIL

SEQ ID NO: 3139 - protein, 898 aa, Homo sapiens
MSVTEEDLCHHMKVVVRVRPENTKEKAAGFHKVVHVVDKHILVFDPKQEEVSFFHGKKTTNQNVIKKQNKDLKFVFDAVFDETSTQSEVFEHTTKPILRSFLNGYNCTVLAYGATGAGKTHTMLGSADEPGVMYLTMLHLYKCMDEIKEEKICSTAVSYLEVYNEQIRDLLVNSGPLAVREDTQKGVVVHGLTLHQPKSSEEILHLLDNGNKNRTQHPTDMNATSSRSHAVFQIYLRQQDKTASINQNVRIAKMSLIDLAGSERASTSGAKGTRFVEGTNINRSLLALGNVINALADSKRKNQHIPYRNSKLTRLLKDSLGGNCQTIMIAAVSPSSVFYDDTYNTLKYANRAKDIKSSLKSNVLNVNNHITQYVKICNEQKAEILLLKEKLKAYEEQKAFTNENDQAKLMISNPQEKEIERFQEILNCLFQNREEIRQEYLKLEMLLKENELKSFYQQQCHKQIEMMCSEDKVEKATGKRDHRLAMLKTRRSYLEKRREEELKQFDENTNWLHRVEKEMGLLSQNGHIPKELKKDLHCHHLHLQNKDLKAQIRHMMDLACLQEQQHRQTEAVLNALLPTLRKQYCTLKEAGLSNAAFESDFKEIEHLVERKKVVVWADQTGEQPKQNDLPGISVLMTFSQLGPVQPIPCCSSSGGTNLVKIPTEKRTRRKLMPSPLKGQHTLKSPPSQSVQLNDSLSKELQPIVYTPEDCRKAFQNPSTVTLMKPSSFTTSFQAISSNINSDNCLKMLCEVAIPHNRRKECGQEDLDSTFTICEDIKSSKCKLPEQESLPNDNKDILQRLDPSSFSTKHSMPVPSMVPSYMAMTTAAKRKRKLTSSTSNSSLTADVNSGFAKRVRQDNSSEKHLQENKPTMEHKRNICKINPSMVRKFGRNISKGNLR

SEQ ID NO: 3140 - protein, 699 aa, Homo sapiens
MPINKSEKPESCDNVKVVVRCRPLNEREKSMCYKQAVSVDEMRGTITVHKTDSSNEPPKTFTFDTVFGPESKQLDVYNLTARPIIDSVLEGYNGTIFAYGQTGTGKTFTMEGVRAIPELRGIIPNSFAHIFGHIAKAEGDTRFLVRVSYLEIYNEEVRDLLGKDQTQRLEVKERPDVGVYIKDLSAYVVNNADDMDRIMTLGHKNRSVGATNMNEHSSRSHAIFTITIECSEKGIDGNMHVRMGKLHLVDLAGSERQAKTGATGQRLKEATKINLSLSTLGNVISALVDGKSTHVPYRNSKLTRLLQDSLGGNSKTMMCANIGPADYNYDETISTLRYANRAKNIKNKARINEDPKDALLRQFQKEIEELKKKLEEGEEISGSDISGSEEDDDEEGEVGEDGEKRKKRRGKKKVSPDKMIEMQAKIDEERKALETKLDMEEEERNKARAELEKREKDLLKAQQEHQSLLEKLSALEKKVIVGGVDLLAKAEEQEKLLEESNMELEERRKRAEQLRRELEEKEQERLDIEEKYTSLQEEAQGKTKKLKKVWTMLMAAKSEMADLQQEHQREIEGLLENIRQLSRELRLQMLIIDNFIPRDYQEMIENYVHWNEDIGEWQLKCVAYTGNNMRKQTPVPDKKEKDPFEVDLSHVYLAYTEESLRQSLMKLERPRTSKGKARPKTGRRKRSAKPETVIDSLLQ

SEQ ID NO: 3141 - protein, 560 aa, Homo sapiens
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGMRKMKLGLVN

SEQ ID NO: 3142 - protein, 616 aa, Homo sapiens
MYDTMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGDGTGSLKRSGSFSKLRASIRRSSEKLVRKLKGGSSRESEPKNPGVSGRASFCGKRQQQQWPGRRHR

SEQ ID NO: 3143 - protein, 521 aa, Homo sapiens
MAENPSLENHRIKSFKNKGRDVETMRRHRNEVTVELRKNKRDEHLLKKRNVPQEESLEDSDVDADFKAQNVTLEAILQNATSDNPVVQLSAVQAARKLLSSDRNPPIDDLIKSGILPILVKCLERDDNPSLQFEAAWALTNIASGTSAQTQAVVQSNAVPLFLRLLRSPHQNVCEQAVWALGNIIGDGPQCRDYVISLGVVKPLLSFISPSIPITFLRNVTWVIVNLCRNKDPPPPMETVQEILPALCVLIYHTDINILVDTVWALSYLTDGGNEQIQMVIDSGVVPFLVPLLSHQEVKVQTAALRAVGNIVTGTDEQTQVVLNCDVLSHFPNLLSHPKEKINKEAVWFLSNITAGNQQQVQAVIDAGLIPMIIHQLAKGDFGTQKEAAWAISNLTISGRKDQVEYLVQQNVIPPFCNLLSVKDSQVVQVVLDGLKNILIMAGDEASTIAEIIEECGGLEKIEVLQQHENEDIYKLAFEIIDQYFSGDDIDEDPCLIPEATQGGTYNFDPTANLQTKEFNF

SEQ ID NO: 3144 - protein, 464 aa, Homo sapiens
MSLQFSNGSRHVCLRSGAGSVRPLNGGAGFAGSSACGGSVAGSEFSCALGGGLGSVPGGSHVGGALGNAACIGFAGSEGGLLSGNEKVTMQNLNDRLASYLDNVRALEEANAELERKIKGWYEKYGPGSCRGLDHDYSRYHLTIEDLKNKIISSTTTNANVILQIDNARLAADDFRLKYENELTLHQNVEADINGLRRVLDELTLCRTDQELQYESLSEEMTYLKKNHEEEMKALQCAAGGNVNVEMNAAPGVDLAVLLNNMRAEYEALAEQNRKDAEAWFNEKSASLQQQISHDSGAATFARSQLTEMRRTLQTLEIQLQSLMATKHSLECSLTETESNYCTQLAQIQAQIGALEEQLHQVRTETEGQKLEYEHLLDVKVHLEKEIETYCRLIDGDGNSCSKSKGFGSGSPGNSSKDLSKTTLVKTVVEELDQRGKVLSSRIHSIEEKTSKMTNGKTEQRVPF

SEQ ID NO: 3145 - protein, 557 aa, Homo sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 3146 - protein, 757 aa, Homo sapiens
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 3147 - protein, 219 aa, Homo sapiens
MVKLLPAQEAAKIYHTNYVRNSRAVGVMWGTLTICFSVLVMALFIQPYWIGDSVNTPQAGYFGLFSYCVGNVLSSELICKGGPLDFSSIPSRAFKTAMFFVALGMFLIIGSIICFSLFFICNTATVYKICAWMQLAAATGLMIGCLVYPDGWDSSEVRRMCGEQTGKYTLGHCTIRWAFMLAILSIGDALILSFLAFVLGYRQDKLLPDDYKADGTEEV

SEQ ID NO: 3148 - protein, 1097 aa, Homo sapiens
MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFTLNEQNVSLIPDTPEILNLSADFSTSTLYLKWNDRGSVFPHRSNVIWEIKVLRKESMELVKLVTHNTTLNGKDTLHHWSWASDMPLECAIHFVEIRCYIDNLHFSGLEEWSDWSPVKNISWIPDSQTKVFPQDKVILVGSDITFCCVSQEKVLSALIGHTNCPLIHLDGENVAIKIRNISVSASSGTNVVFTTEDNIFGTVIFAGYPPDTPQQLNCETHDLKEIICSWNPGRVTALVGPRATSYTLVESFSGKYVRLKRAEAPTNESYQLLFQMLPNQEIYNFTLNAHNPLGRSQSTILVNITEKVYPHTPTSFKVKDINSTAVKLSWHLPGNFAKINFLCEIEIKKSNSVQEQRNVTIKGVENSSYLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPSNSTETVIESDEFRPGIRYNFFLYGCRNQGYQLLRSMIGYIEELAPIVAPNFTVEDTSADSILVKWEDIPVEELRGFLRGYLFYFGKGERDTSKMRVLESGRSDIKVKNITDISQKTLRIADLQGKTSYHLVLRAYTDGGVGPEKSMYVVTKENSVGLIIAILIPVAVAVIVGVVTSILCYRKREWIKETFYPDIPNPENCKALQFQKSVCEGSSALKTLEMNPCTPNNVEVLETRSAFPKIEDTEIISPVAERPEDRSDAEPENHVVVSYCPPIIEEEIPNPAADEAGGTAQVIYIDVQSMYQPQAKPEEEQENDPVGGAGYKPQMHLPINSTVEDIAAEEDLDKTAGYRPQANVNTWNLVSPDSPRSIDSNSEIVSFGSPCSINSRQFLIPPKDEDSPKSNGGGWSFTNFFQNKPND

SEQ ID NO: 3149 - protein, 490 aa, Homo sapiens
MEGQDEVSAREQHFHSQVRESTICFLLFAILYVVSYFIITRYKRKSDEQEDEDAIVNRISLFLSTFTLAVSAGAVLLLPFSIISNEILLSFPQNYYIQWLNGSLIHGLWNLASLFSNLCLFVLMPFAFFFLESEGFAGLKKGIRARILETLVMLLLLALLILGIVWVASALIDNDAASMESLYDLWEFYLPYLYSCISLMGCLLLLLCTPVGLSRMFTVMGQLLVKPTILEDLDEQIYIITLEEEALQRRLNGLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDSETAKPSVNGHQKAL

SEQ ID NO: 3150 - protein, 387 aa, Homo sapiens
MGCAYSCCLEVCCGEDEIVYPRMPGESTVCHREREKPITYHWYHWHPGHIYPRVASMEDYDEDLVQEASSEDVLGVHMVDKDTERDIEMKRQLRRLRELHLYSTWKKYQEAMKTSLGVPQCERDEGSLGKPLCPPEILSETLPGSVKKRVCFPSEDHLEEFIAEHLPEASNQSLLTVAHADTGIQTNGDLEDLEEHGPGQTVSEEATEVHMMEGDPDTLAELLIRDVLQELSSYNGEEEDPEEVKTSLGVPQRGDLEDLEEHVPGQTVSEEATGVHMMQVDPATPAKSDLEDLEEHVPGQTVSEEATGVHMMQVDPATLAKQLEDSTITGSHQQMSASPSSAPAEEATEKTKVEEEVKTRKPKKKTRKPSKKSRWNVLKCWDIFNIF

SEQ ID NO: 3151 - protein, 387 aa, Homo sapiens; identical to SEQ ID NO: 3150

SEQ ID NO: 3152 - protein, 144 aa, Homo sapiens
MVDKDTERDIEMKRQLRRLRELHLYSTWKKYQEAMKTSLGVPQRGDLEDLEEHVPGQTVSEEATGVHMMQVDPATPAKKLEDSTITGSHQQMSASPSSAPAEEATEKTKVEEEVKTRKPKKKTRKPSKKSRWNVLKCWDIFNIF

SEQ ID NO: 3153 - protein, 144 aa, Homo sapiens; identical to SEQ ID NO: 3152

SEQ ID NO: 3154 - protein, 114 aa, Homo sapiens
MVDKDTERDIEMKRQLRRLRELHLYSTWKKYQEAMKTSLGVPQRGDLEDLEEHVPGQTVSEEATGVHMMQVDPATPAKKLEDSTITGSHQQMSASPSSAPAEEATEKTKVEEEV

SEQ ID NO: 3155 - protein, 310 aa, Homo sapiens
MVDKDTERDIEMKRQLRRLRELHLYSTWKKYQEAMKTSLGVPQCERDEGSLGKPLCPPEILSETLPGSVKKRVCFPSEDHLEEFIAEHLPEASNQSLLTVAHADTGIQTNGDLEDLEEHGPGQTVSEEATEVHMMEGDPDTLAELLIRDVLQELSSYNGEEEDPEEVKTSLGVPQRGDLEDLEEHVPGQTVSEEATGVHMMQVDPATPAKSDLEDLEEHVPGQTVSEEATGVHMMQVDPATLAKQLEDSTITGSHQQMSASPSSAPAEEATEKTKVEEEVKTRKPKKKTRKPSKKSRWNVLKCWDIFNIF

SEQ ID NO: 3156 - protein, 387 aa, Homo sapiens; identical to SEQ ID NO: 3150

SEQ ID NO: 3157 - protein, 387 aa, Homo sapiens; identical to SEQ ID NO: 3150

SEQ ID NO: 3158 - protein, 387 aa, Homo sapiens; identical to SEQ ID NO: 3150

SEQ ID NO: 3159 - protein, 221 aa, Homo sapiens [sequence omitted]

SEQ ID NO: 3160 - protein, 127 aa, Homo sapiens
METALKIKESEGRRSVLPTIRQKERAPNDQAEGACAQRSGRRSVRPTIRQKKRAPNDRAEGACAQRSGRRSVLPTIGQNERAPNDRAEGACAQRSGRRSVRPTIGQKERAPKIGQKEREPSDRAEGA

SEQ ID NO: 3161 - protein, 74 aa, Homo sapiens [sequence omitted]

SEQ ID NO: 3162 - protein, 127 aa, Homo sapiens; identical to SEQ ID NO: 3160

SEQ ID NO: 3163 - protein, 74 aa, Homo sapiens [sequence omitted]

SEQ ID NO: 3164 - protein, 904 aa, Homo sapiens [sequence omitted]

SEQ ID NO: 3165 - protein, 653 aa, Homo sapiens
MKLLWQVTVHHHTWNAILLPFVYLTAQVWILCAAIAAAASAGPQNCPSVCSCSNQFSKVVCTRRGLSEVPQGIPSNTRYLNLMENNIQMIQADTFRHLHHLEVLQLGRNSIRQIEVGAFNGLASLNTLELFDNWLTVIPSGAFEYLSKLRELWLRNNPIESIPSYAFNRVPSLMRLDLGELKKLEYISEGAFEGLFNLKYLNLGMCNIKDMPNLTPLVGLEELEMSGNHFPEIRPGSFHGLSSLKKLWVMNSQVSLIERNAFDGLASLVELNLAHNNLSSLPHDLFTPLRYLVELHLHHNPWNCDCDILWLAWWLREYIPTNSTCCGRCHAPMHMRGRYLVEVDQASFQCSAPFIMDAPRDLNISEGRMAELKCRTPPMSSVKWLLPNGTVLSHASRHPRISVLNDGTLNFSHVLLSDTGVYTCMVTNVAGNSNASAYLNVSTAELNTSNYSFFTTVTVETTEISPEDTTRKYKPVPTTSTGYQPAYTTSTTVLIQTTRVPKQVAVPATDTTDKMQTSLDEVMKTTKIIIGCFVAVTLLAAAMLIVFYKLRKRHQQRSTVTAARTVEIIQVDEDIPAATSAAATAAPSGVSGEGAVVLPTIHDHINYNTYKPAHGAHWTENSLGNSLHPTVTTISEPYIIQTHTKDKVQETQI

SEQ ID NO: 3166 - protein, 640 aa, Homo sapiens
MLNKMTLHPQQIMIGPRFNRALFDPLLVVLLALQLLVVAGLVRAQTCPSVCSCSNQFSKVICVRKNLREVPDGISTNTRLLNLHENQIQIIKVNSFKHLRHLEILQLSRNHIRTIEIGAFNGLANLNTLELFDNRLTTIPNGAFVYLSKLKELWLRNNPIESIPSYAFNRIPSLRRLDLGELKRLSYISEGAFEGLSNLRYLNLAMCNLREIPNLTPLIKLDELDLSGNHLSAIRPGSFQGLMHLQKLWMIQSQIQVIERNAFDNLQSLVEINLAHNNLTLLPHDLFTPLHHLERIHLHHNPWNCNCDILWLSWWIKDMAPSNTACCARCNTPPNLKGRYIGELDQNYFTCYAPVIVEPPADLNVTEGMAAELKCRASTSLTSVSWITPNGTVMTHGAYKVRIAVLSDGTLNFTNVTVQDTGMYTCMVSNSVGNTTASATLNVTAATTTPFSYFSTVTVETMEPSQDEARTTDNNVGPTPVVDWETTNVTTSLTPQSTRSTEKTFTIPVTDINSGIPGIDEVMKTTKIIIGCFVAITLMAAVMLVIFYKMRKQHHRQNHHAPTRTVEIINVDDEITGDTPMESHLPMPAIEHEHLNHYNSYKSPFNHTTTVNTINSIHSSVHEPLLIRMNSKDNVQETQI

SEQ ID NO: 3167 - protein, 3801 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTEKGKKIKKRNKSLILPDSSFDGTESDRPEGAEYINPGERLIEEGCIHIISLGSKALMIQVWADPHNATLIFRVCMDSNDDMKAVLLAQVESQENIFLPSKWQHLVLTYLQQPQGKRRIHGKISIWVSGQRKPDVTLDFMLPRKTSLSSDSNKTFCMIGHCLSSQEEFLQLAGKWDLGNLLLFNGAKVGSQEAFYLYACGPNHTSVMPCKYGKPVNDYSKYINKEILRCEQIRELFMTKKDVDIGLLIESLSVVYTTYCPAQYTIYEPVIRLKGQMKTQLSQRPFSSKEVQSILLEPHHLKNLQPTEYKTIQGILHEIGGTGIFVFLFARVVELSSCEETQALALRVILSLIKYNQQRVHELENCNGLSMIHQVLIKQKCIVGFYILKTLLEGCCGEDIIYMNENGEFKLDVDSNAIIQDVKLLEELLLDWKIWSKAEQGVWETLLAALEVLIRADHHQQMFNIKQLLKAQVVHHFLLTCQVLQEYKEGQLTPMPREVCRSFVKIIAEVLGSPPDLELLTIIFNFLLAVHPPTNTYVCHNPTNFYFSLHIDGKIFQEKVRSIMYLRHSSSGGRSLMSPGFMVISPSGFTASPYEGENSSNIIPQQMAAHMLRSRSLPAFPTSSLLTQSQKLTGSLGCSIDRLQNIADTYVATQSKKQNSLGSSDTLKKGKEDAFISSCESAKTVCEMEAVLSAQVSVSDVPKGVLGFPVVKADHKQLGAEPRSEDDSPGDESCPRRPDYLKGLASFQRSHSTIASLGLAFPSQNGSAAVGRWPSLVDRNTDDWENFAYSLGYEPNYNRTASAHSVTEDCLVPICCGLYELLSGVLLILPDVLLEDVMDKLIQADTLLVLVNHPSPAIQQGVIKLLDAYFARASKEQKDKFLKNRGFSLLANQLYLHRGTQELLECFIEMFFGRHIGLDEEFDLEDVRNMGLFQKWSVIPILGLIETSLYDNILLHNALLLLLQILNSCSKVADMLLDNGLLYVLCNTVAALNGLEKNIPMSEYKLLACDIQQLFIAVTIHACSSSGSQYFRVIEDLIVMLGYLQNSKNKRTQNMAVALQLRVLQAAMEFIRTTANHDSENLTDSLQSPSAPHHAVVQKRKSIAGPRKFPLAQTESLLMKMRSVANDELHVMMQRRMSQENPSQATETELAQRLQRLTVLAVNRIIYQEFNSDIIDILRTPENVTQSKTSVFQTEISEENIHHEQSSVFNPFQKEIFTYLVEGFKVSIGSSKASGSKQQWTKILWSCKETFRMQLGRLLVHILSPAHAAQERKQIFEIVHEPNHQEILRDCLSPSLQHGAKLVLYLSELIHNHQGELTEEELGTAELLMNALKLCGHKCIPPSASTKADLIKMIKEEQKKYETEEGVNKAAWQKTVNNNQQSLFQRLDSKSKDISKIAADITQAVSLSQGNERKKVIQHIRGMYKVDLSASRHWQELIQQLTHDRAVWYDPIYYPTSWQLDPTEGPNRERRRLQRCYLTIPNKYLLRDRQKSEDVVKPPLSYLFEDKTHSSFSSTVKDKAASESIRVNRRCISVAPSRETAGELLLGKCGMYFVEDNASDTVESSSLQGELEPASFSWTYEEIKEVHKRWWQLRDNAVEIFLTNGRTLLLAFDNTKVRDDVYHNILTNNLPNLLEYGNITALTNLWYTGQITNFEYLTHLNKHAGRSFNDLMQYPVFPFILADYVSETLDLNDLLIYRNLSKPIAVQYKEKEDRYVDTYKYLEEEYRKGAREDDPMPPVQPYHYGSHYSNSGTVLHFLVRMPPFTKMFLAYQDQSFDIPDRTFHSTNTTWRLSSFESMTDVKELIPEFFYLPEFLVNREGFDFGVRQNGERVNHVNLPPWARNDPRLFILIHRQALESDYVSQNICQWIDLVFGYKQKGKASVQAINVFHPATYFGMDVSAVEDPVQRRALETMIKTYGQTPRQLFHMAHVSRPGAKLNIEGELPAAVGLLVQFAFRETREQVKEITYPSPLSWIKGLKWGEYVGSPSAPVPVVCFSQPHGERFGSLQALPTRAICGLSRNFCLLMTYSKEQGVRSMNSTDIQWSAILSWGYADNILRLKSKQSEPPVNFIQSSQQYQVTSCAWVPDSCQLFTGSKCGVITAYTNRFTSSTPSEIEMETQIHLYGHTEEITSLFVCKPYSILISVSRDGTCIIWDLNRLCYVQSLAGHKSPVTAVSASETSGDIATVCDSAGGGSDLRLWTVNGDLVGHVHCREIICSVAFSNQPEGVSINVIAGGLENGIVRLWSTWDLKPVREITFPKSNKPIISLTFSCDGHHLYTANSDGTVIAWCRKDQQRLKQPMFYSFLSSYAAG

SEQ ID NO: 3168 - protein, 2001 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTEKGKKIKKRNKSLILPDSSFDGTESDRPEGAEYINPGERLIEEGCIHIISLGSKALMIQVWADPHNATLIFRVCMDSNDDMKAVLLAQVESQENIFLPSKWQHLVLTYLQQPQGKRRIHGKISIWVSGQRKPDVTLDFMLPRKTSLSSDSNKTFCMIGHCLSSQEEFLQLAGKWDLGNLLLFNGAKVGSQEAFYLYACGPNHTSVMPCKYGKPVNDYSKYINKEILRCEQIRELFMTKKDVDIGLLIESLSVVYTTYCPAQYTIYEPVIRLKGQMKTQLSQRPFSSKEVQSILLEPHHLKNLQPTEYKTIQGILHEIGGTGIFVFLFARVVELSSCEETQALALRVILSLIKYNQQRVHELENCNGLSMIHQVLIKQKCIVGFYILKTLLEGCCGEDIIYMNENGEFKLDVDSNAIIQDVKLLEELLLDWKIWSKAEQGVWETLLAALEVLIRADHHQQMFNIKQLLKAQVVHHFLLTCQVLQEYKEGQLTPMPREMARSFRRKCGQSCT

SEQ ID NO: 3169 - protein, 1125 aa, Homo sapiens
MSKTLKKKRHWLSKVQECAVSWAGPPGDFGAEIRGGAERGEFPYLGRLREEPGGGTCCVVSGKAPSPGDVLLEVNGTPVSGLTNRDTLAVIRHFREPIRLKTVKPGKVINKDLRHYLSLQFQKGSIDHKLQQVIRDNLYLRTIPCTTRAPRDGEVPGVDYNFISVEQFKALEESGALLESGTYDGNFYGTPKPPAEPSPFQPDPVDQVLFDNEFDAESQRKRTTSVSKMERMDSSLPEEEEDEDKEAINGSGNAENGERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCVDGIPVKGKSHKQVLDLMTTAAPNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWPDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGLAPSGLCSYVKPEQH

SEQ ID NO: 3170 - protein, 626 aa, Homo sapiens
MDEQEALNSIMNDLVALQMNRRHRMPGYETMKNKDTGHSNRQSDVRIKFEHNGERRIIAFSRPVKYEDVEHKVTTVFGQPLDLHYMNNELSILLKNQDDLDKAIDILDRSSSMKSLRILLLSQDRNHNSSSPHSGVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 3171 - protein, 657 aa, Homo sapiens
MDEQEALNSIMNDLVALQMNRRHRMPGYETMKNKDTGHSNRQKKHNSSSSALLNSPTVTTSSCAGASEKKKFLSDVRIKFEHNGERRIIAFSRPVKYEDVEHKVTTVFGQPLDLHYMNNELSILLKNQDDLDKAIDILDRSSSMKSLRILLLSQDRNHNSSSPHSGVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 3172 - protein, 693 aa, Homo sapiens
MAQGSHQIDFQVLHDLRQKFPEVPEVVVSRCMLQNNNNLDACCAVLSQESTRYLYGEGDLNFSDDSGISGLRNHMTSLNLDLQSQNIYHHGREGSRMNGSRTLTHSISDGQLQGGQSNSELFQQEPQTAPAQVPQGFNVFGMSSSSGASNSAPHLGFHLGSKGTSSLSQQTPRFNPIMVTLAPNIQTGRNTPTSLHIHGVPPPVLNSPQGNSIYIRPYITTPGGTTRQTQQHSGWVSQFNPMNPQQVYQPSQPGPWTTCPASNPLSHTSSQQPNQQGHQTSHVYMPISSPTTSQPPTIHSSGSSQSSAHSQYNIQNISTGPRKNQIEIKLEPPQRNNSSKLRSSGPRTSSTSSSVNSQTLNRNQPTVYIAASPPNTDELMSRSQPKVYISANAATGDEQVMRNQPTLFISTNSGASAASRNMSGQVSMGPAFIHHHPPKSRAIGNNSATSPRVVVTQPNTKYTFKITVSPNKPPAVSPGVVSPTFELTNLLNHPDHYVETENIQHLTDPTLAHVDRISETRKLSMGSDDAAYTQALLVHQKARMERLQRELEIQKKKLDKLKSEVNEMENNLTRRRLKRSNSISQIPSLEEMQQLRSCNRQLQIDIDCLTKEIDLFQARGPHFNPSAIHNFYDNIGFVGPVPPKPKDQRSIIKTPKTQDTEDDEGAQWNCTACTFLNHPALIRCEQCEMPRHF

SEQ ID NO: 3173 - protein, 384 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 3174 - protein, 384 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 3175 - protein, 427 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 3176 - protein, 427 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 3177 - protein, 2617 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSSTSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQASLLPSVPALKGEIPSPQLTRPKKRIGRPMVASPNQRHQDHLRPKVPAGVQELTHCPDTPLLPPSDSRGHNSSNSPSLQAGGAEGAGDRGRDTR

SEQ ID NO: 3178 - protein, 208 aa, Homo sapiens
MEAPPVTMMPVTGGTINMMEYLLQGSVLDHSLESLIHRLRGLCDNMEPETFLDHEMVFLLKGQQASPFVLRARRSMDRAGAPWHLRYLGQPEMGDKNRHALVRNCVDIATSENLTDFLMEMGFRMDHEFVAKGHLFRKGIMKIMVYKTFRILVPGNTDSTEALSLSYLVELSVVAPAGQDMVSDDMKNFAEQLKPLVHLEKIDPKRLM

SEQ ID NO: 3179 - protein, 381 aa, Homo sapiens
MDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 3180 - protein, 302 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTVY

SEQ ID NO: 3181 - protein, 394 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 3182 - protein, 477 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGLQSMPGDYVSQGGPMGMSMAQPSYTPPQMTPHPTQLRHGPPMHSYLPSHPHHPAMMMHGGPPTHPGMTMSAQSPTMLNSVDPNVGGQVMDIHAQ

SEQ ID NO: 3183 - protein, 470 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGLQSMPGDYVSQGGPMGMSMAQPSYTPPQMTPHPTQLRHGPPMHSYLPSHPHHPAMMMHGGPPTHPGMTMSAQSPTMLNSVDPNVGGQVMDIHAQ

SEQ ID NO: 3184 - protein, 401 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGPMSGMGMNMGMDGQWHYM

SEQ ID NO: 3185 - protein, 388 aa, Homo sapiens
MDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGPMSGMGMNMGMDGQWHYM

SEQ ID NO: 3186 - protein, 306 aa, Homo sapiens
MALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 3187 - protein, 963 aa, Homo sapiens
MAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 3188 - protein, 102 aa, Homo sapiens
MMSIRQRREIRATEVSEDFPAQEENVKLENKLPSGCTSRRLWKILSLTIGGTIALCIGLLTSVYLATLHENDLWFSNIKVWSFFDHCIIHSVGSPVVSHVDE

SEQ ID NO: 3189 - protein, 2042 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 3190 - protein, 125 aa, Homo sapiens
MPRYELALILKAMQRPETAATLKRTIEALMDRGAIVRDLENLGERALPYRISAHSQQHNRGGYFLVDFYAPTAAVESMVEHLSRDIDVIRGNIVKHPLTQELKECEGIVPVPLAEKLYSTKKRKK

SEQ ID NO: 3191 - protein, 283 aa, Homo sapiens
MASGTTTTAVKIGIIGGTGLDDPEILEGRTEKYVDTPFGKPSDALILGKIKNVDCVLLARHGRQHTIMPSKVNYQANIWALKEEGCTHVIVTTACGSLREEIQPGDIVIIDQFIDRTTMRPQSFYDGSHSCARGVCHIPMAEPFCPKTREVLIETAKKLGLRCHSKGTMVTIEGPRFSSRAESFMFRTWGADVINMTTVPEVVLAKEAGICYASIAMATDYDCWKEHEEAVSVDRVLKTLKENANKAKSLLLTTIPQIGSTEWSETLHNLKNMAQFSVLLPRH

SEQ ID NO: 3192 - protein, 660 aa, Homo sapiens
MEHIRTPKVENVRLVDRVSPKKAALGTLYLTATHVIFVENSPDARKETWILHSQISTIEKQATTATGCPLLIRCKNFQIIQLIIPQERDCHDVYISLIRLARPVKYEELYCFSFNPMLDKEEREQGWVLIDLSEEYTRMGLPNHYWQLSDVNRDYRVCDSYPTELYVPKSATAHIIVGSSKFRSRRRFPVLSYYYKDNHASICRSSQPLSGFSARCLEDEQMLQAIRKANPGSDFVYVVDARPKLNAMANRAAGKGYENEDNYSNIKFQFIGIENIHVMRNSLQKMLEVCELKSPSMSDFLWGLENSGWLRHIKAIMDAGIFIAKAVSEEGASVLVHCSDGWDRTAQVCSVASLLLDPHYRTLKGFMVLIEKDWISFGHKFNHRYGNLDGDPKEISPVIDQFIECVWQLMEQFPCAFEFNERFLIHIQHHIYSCQFGNFLCNSQKERRELKIQERTYSLWAHLWKNRADYLNPLFRADHSQTQGTLHLPTTPCNFMYKFWSGMYNRFEKGMQPRQSVTDYLMAVKEETQQLEEELEALEERLEKIQKVQLNCTKVKSKQSEPSKHSGFSTSDNSIANTPQDYSGNMKSFPSRSPSQGDEDSALILTQDNLKSSDPDLSANSDQESGVEDLSCRSPSGGEHAPSEDSGKDRDSDEAVFLTA

SEQ ID NO: 3193 - protein, 1270 aa, Homo sapiens
MTDDNSDDKIEDELQTFFTSDKDGNTHAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSGKPTSLKTAQSSWVNLPRPLPKSKASLKSPALRRTGSTPSIASTHSELSTYSNNSGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 3194 - protein, 1216 aa, Homo sapiens
MTDDNSDDKIEDELQTFFTSDKDGNTHAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSAGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 3195 - protein, 770 aa, Homo sapiens
MTDDNSDDKIEDELQTFFTSDKDGNTHAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSVLPKAAFS

SEQ ID NO: 3196 - protein, 517 aa, Homo sapiens
MTVPGGFRSCTETDISSKIFINSTLTPPAGSERHYDATLLTLLVVGSYSLCIIPLLATFTGKKTGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 3197 - protein, 436 aa, Homo sapiens
MLLSPKFSLSTIHIRLTAKGLLRNLRLPSGFRRSTVVFHTVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 3198 - protein, 391 aa, Homo sapiens
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 3199 - protein, 391 aa, Homo sapiens; identical to SEQ ID NO: 3198

SEQ ID NO: 3200 - protein, 6669 aa, Homo sapiens
MADDEDYEEVVEYYTEEVVYEEVPGETITKIYETTTTRTSDYEQSETSKPALAQPALAQPASAKPVERRKVIRKKVDPSKFMTPYIAHSQKMQDLFSPNKYKEKFEKTKGQPYASTTDTPELRRIKKVQDQLSEVKYRMDGDVAKTICHVDEKAKDIEHAKKVSQQVSKVLYKQNWEDTKDKYLLPPDAPELVQAVKNTAMFSKKLYTEDWEADKSLFYPYNDSPELRRVAQAQKALSDVAYKKGLAEQQAQFTPLADPPDIEFAKKVTNQVSKQKYKEDYENKIKGKWSETPCFEVANARMNADNISTRKYQEDFENMKDQIYFMQTETPEYKMNKKAGVAASKVKYKEDYEKNKGKADYNVLPASENPQLRQLKAAGDALSDKLYKENYEKTKAKSINYCETPKFKLDTVLQNFSSDKKYKDSYLKDILGHYVGSFEDPYHSHCMKVTAQNSDKNYKAEYEEDRGKGFFPQTITQEYEAIKKLDQCKDHTYKVHPDKTKFTQVTDSPVLLQAQVNSKQLSDLNYKAKHESEKFKCHIPPDTPAFIQHKVNAYNLSDNLYKQDWEKSKAKKFDIKVDAIPLLAAKANTKNTSDVMYKKDYEKNKGKMIGVLSINDDPKMLHSLKVAKNQSDRLYKENYEKTKAKSMNYCETPKYQLDTQLKNFSEARYKDLYVKDVLGHYVGSMEDPYHTHCMKVAAQNSDKSYKAEYEEDKGKCYFPQTITQEYDAIKKLDQCKDHTYKVHPDKTKFTAVTDSPVLLQAQLNTKQLSDLNYKAKHEGERFKCHIPADAPQFIQHRVNAYNLSDNVYKQDWEKSKAKKFDIKVDAIPLLAAKANTKNTSDVMYKKDYEKSKGKMIGALSINDDPKMLHSLKTAKNQSDREYRKDYEKSKTIYTAPLDMLQVTQAKKSQAIASDVDYKHILHSYSYPPDSINVDLAKKAYALQSDVEYKADYNSWMKGCGWVPFGSLEMEKAKRASDILNEKKYRQHPDTLKFTSIEDAPITVQSKINQAQRSDIAYKAKGEEIIHNYNLPPDLPQFIQAKVNAYNISENMYKADLKDLSKKGYDLRTDAIPIRAAKAARQAASDVQYKKDYEKAKGKMVGFQSLQDDPKLVHYMNVAKIQSDREYKKDYEKTKSKYNTPHDMFNVVAAKKAQDVVSNVNYKHSLHHYTYLPDAMDLELSKNMMQIQSDNVYKEDYNNWMKGIGWIPIGSLDVEKVKKAGDALNEKKYRQHPDTLKFTSIVDSPVMVQAKQNTKQVSDILYKAKGEDVKHKYTMSPDLPQFLQAKCNAYSISDVCYKRDWHDLIRKGNNVLGDAIPITAAKASRNIASDYKYKEAYEKSKGKHVGFRSLQDDPKLVHYMNVAKLQSDREYKKNYENTKTSYHTPGDMVTITAAKMAQDVATNVNYKQPLHHYTYLPDAMSLEHTRNVNQIQSDNVYKDEYNSFLKGIGWIPIGSLEVEKVKKAGDALNERKYRQHPDTVKFTSVPDSMGMMLAQHNTKQLSDLNYKVEGEKLKHKYTIDPELPQFIQAKVNALNMSDAHYKADWKKTIRKGYDLRPDAIPIVAAKSSRNIASDCKYKEAYEKAKGKQVGFLSLQDDPKLVHYMNVAKIQSDREYKKGYEASKTKYHTPLDMVSVTAAKKSQEVATNANYRQSYHHYTLLPDALNVEHSRNAMQIQSDNLYKSDFTNWMKGIGWVPIESLEVEKAKKAGEILSEKKYRQHPEKLKFTYAMDTMEQALNKSNKLNMDKRLYTEKWNKDKTTIHVMPDTPDILLSRVNQITMSDKLYKAGWEEEKKKGYDLRPDAIAIKAARASRDIASDYKYKKAYEQAKGKHIGFRSLEDDPKLVHFMQVAKMQSDREYKKGYEKSKTSFHTPVDMLSVVAAKKSQEVATNANYRNVIHTYNMLPDAMSFELAKNMMQIQSDNQYKADYADFMKGIGWLPLGSLEAEKNKKAMEIISEKKYRQHPDTLKYSTLMDSMNMVLAQNNAKIMNEHLYKQAWEADKTKVHIMPDIPQIILAKANAINISDKLYKLSLEESKKKGYDLRPDAIPIKAAKASRDIASDYKYKYNYEKGKGKMVGFRSLEDDPKLVHSMQVAKMQSDREYKKNYENTKTSYHTPADMLSVTAAKDAQANITNTNYKHLIHKYILLPDAMNIELTRNMNRIQSDNEYKQDYNEWYKGLGWSPAGSLEVEKAKKATEYASDQKYRQHPSNFQFKKLTDSMDMVLAKQNAHTMNKHLYTIDWNKDKTKIHVMPDTPDILQAKQNQTLYSQKLYKLGWEEALKKGYDLPVDAISVQLAKASRDIASDYKYKQGYRKQLGHHVGFRSLQDDPKLVLSMNVAKMQSEREYKKDFEKWKTKFSSPVDMLGVVLAKKCQELVSDVDYKNYLHQWTCLPDQNDVVQAKKVYELQSENLYKSDLEWLRGIGWSPLGSLEAEKNKRASEIISEKKYRQPPDRNKFTSIPDAMDIVLAKTNAKNRSDRLYREAWDKDKTQIHIMPDTPDIVLAKANLINTSDKLYRMGYEELKRKGYDLPVDAIPIKAAKASREIASEYKYKEGFRKQLGHHIGARNIEDDPKMMWSMHVAKIQSDREYKKDFEKWKTKFSSPVDMLGVVLAYKCQTLVSDVDYKNYLHQWTCLPDQSDVIHARQAYDLQSDNLYKSDLQWLKGIGWMTSGSLEDEKNKRATQILSDHVYRQHPDQFKFSSLMDSIPMVLAKNNAITMNHRLYTEAWDKDKTTVHIMPDTPEVLLAKQNKVNYSEKLYKLGLEEAKRKGYDMRVDAIPIKAAKASRDIASEFKYKEGYRKQLGHHIGARAIRDDPKMMWSMHVAKIQSDREYKKDFEKWKTKFSSPVDMLGVVLAKKCQTLVSDVDYKNYLHQWTCLPDQSDVIHARQAYDLQSDNMYKSDLQWMRGIGWVSIGSLDVEKCKRATEILSDKIYRQPPDRFKFTSVTDSLEQVLAKNNALNMNKRLYTEAWDKDKTQIHIMPDTPEIMLARQNKINYSETLYKLANEEAKKKGYDLRSDAIPIVAAKASRDVISDYKYKDGYRKQLGHHIGARNIEDDPKMMWSMHVAKIQSDREYKKDFEKWKTKFSSPVDMLGVVLAKKCQTLVSDVDYKNYLHEWTCLPDQNDVIHARQAYDLQSDNIYKSDLQWLRGIGWVPIGSMDVVKCKRAAEILSDNIYRQPPDKLKFTSVTDSLEQVLAKNNALNMNKRLYTEAWDKDKTQVHIMPDTPEIMLARQNKINYSESLYRQAMEEAKKEGYDLRSDAIPIVAAKASRDIASDYKYKEAYRKQLGHHIGARAVHDDPKIMWSLHIAKVQSDREYKKDFEKYKTRYSSPVDMLGIVLAKKCQTLVSDVDYKHPLHECICLPDQNDIIHARKAYDLQSDNLYKSDLEWMKGIGWVPIDSLEVVRAKRAGELLSDTIYRQRPETLKFTSITDTPEQVLAKNNALNMNKRLYTEAWDNDKKTIHVMPDTPEIMLAKLNRINYSDKLYKLALEESKKEGYDLRLDAIPIQAAKASRDIASDYKYKEGYRKQLGHHIGARNIKDDPKMMWSIHVAKIQSDREYKKEFEKWKTKFSSPVDMLGVVLAKKCQILVSDIDYKHPLHEWTCLPDQNDVIQARKAYDLQSDAIYKSDLEWLRGIGWVPIGSVEVEKVKRAGEILSDRKYRQPADQLKFTCITDTPEIVLAKNNALTMSKHLYTEAWDADKTSIHVMPDTPDILLAKSNSANISQKLYTKGWDESKMKDYDLRADAISIKSAKASRDIASDYKYKEAYEKQKGHHIGAQSIEDDPKIMCAIHAEKIQSEREYKKEFQKWKTKFSSPVDMLSILLAKKCQTLVTDIYYRNYLHEWTCMPDQNDIIQAKKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFTSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDPPEIRQVKKTQEAVSELIYKSDFFKMQGHMISLPYTPQVIHCRYVGDITSDIKYKEDLQVLKGFGCFLYDTPDMVRSRHLRKLWSNYLYTDKAREMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNEKKYRADYEQRKDKYHLVVDEPRHLLAKTRSDQISQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSVLYKENMGKGTPLPVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSVSGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 3201 - protein, 544 aa, Homo sapiens
MSSFSYEPYYSTSYKRRYVETPRVHISVRSGYSTARSAYSSYSAPVSSSLSVRRSYSSSSGSLMPSLENLDLSQVAAISNDLKSIRTQEKAQLQDLNDRFASFIERVHELEQQNKVLEAELLVLRQKHSEPSRFRALYEQEIRDLRLAAEDATTNEKQALRGEREEGLEETLRNLQARYEEEVLSREDAEGRLMERRKGADEAALARAELEKRIDSLMDEISFLKKVHEEEIAELQAQIQYAQISVEMDVTKPDLSAALKDIRAQYEKLAAKNMQNAEEWFKSRFTVLTESAAKNTDAVRAAKDEVSESRRLLKAKTLEIEACRGMNEALEKQLQELEDKQNADISAMQDTINKLENELRTTKSEMARYLKEYQDLLNVKMALDIEIAAYRKLLEGEETRLSFTSVGSITSGYSQSSQVFGRSAYGGLQTSSYLMSTRSFPSYYTSHVQEEQTEVEETIEASKAEEAKDEPPSEGEAEEEEKDKEEAEEEEAAEEEEAAKEESEEAKEEEEGGEGEEGEETKEAEEEEKKVEGAGEEQAAKKKD

SEQ ID NO: 3202 - protein, 645 aa, Homo sapiens
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIGDFGVSRLLMGSCDLATTLTGTPHYMSPEALKHQGYDTKSDIWSLACILYEMCCMNHAFAGSNFLSIVLKIVEGDTPSLPERYPKELNAIMESMLNKNPSLRPSAIEILKIPYLDEQLQNLMCRYSEMTLEDKNLDCQKEAAHIINAMQKRIHLQTLRALSEVQKMTPRERMRLRKLQAADEKARKLKKIVEEKYEENSKRMQELRSRNFQQLSVDVLHEKTHLKGMEEKEEQPEGRLSCSPQDEDEERWQGREEESDEPTLENLPESQPIPSMDLHELESIVEDATSDLGYHEIPEDPLVAEEYYADAFDSYCVESDEEEEEIALERPEKEIRNEGSQPAYRTNQQDSDIEALARCLENVLGCTSLDTKTITTMAEDMSPGPPIFNSVMARTKMKRMRESAMQKLGTEVFEEVYNYLKRARHQNASEAEIRECLEKVVPQASDCFEVDQLLYFEEQLLITMGKEPTLQNHL

SEQ ID NO: 3203 - protein, 470 aa, Homo sapiens
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIGDFGVSRLLMGSCDLATTLTGTPHYMSPEALKHQGYDTKSDIWSLACILYEMCCMNHAFAGSNFLSIVLKIVEGDTPSLPERYPKELNAIMESMLNKNPSLRPSAIEILKIPYLDEQLQNLMCRYSEMTLEDKNLDCQKEAAHIINAMQKRIHLQTLRALSEVQKMTPRERMRLRKLQAADEKARKLKKIVEEKYEENSKRMQELRSRNFQQLSVDVLHEKTHLKGMEEKEEQPEGRLSCSPQDEDEERWQGREEESDEPTLENLPESQPIPSMDLHELESIVEDATSDLGYHATHS

SEQ ID NO: 3204 - protein, 471 aa, Homo sapiens
MQSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKAGEVFIHKDKGFGFIRLETRTLAEIAKVELDNMPLRGKQLRVRFACHSASLTVRNLPQYVSNELLEEAFSVFGQVERAVVIVDDRGRPSGKGIVEFSGKPAARKALDRCSEGSFLLTTFPRPVTVEPMDQLDDEEGLPEKLVIKNQQFHKEREQPPRFAQPGSFEYEYAMRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 3205 - protein, 385 aa, Homo sapiens
MSKPAGSTSRILDIPCKVCGDRSSGKHYGVYACDGCSGFFKRSIRRNRTYVCKSGNQGGCPVDKTHRNQCRACRLKKCLEVNMNKDAVQHERGPRTSTIRKQVALYFRGHKEENGAAAHFPSAALPAPAFFTAVTQLEPHGLELAAVSTTPERQTLVSLAQPTPKYPHEVNGTPMYLYEVATESVCESAARLLFMSIKWAKSVPAFSTLSLQDQLMLLEDAWRELFVLGIAQWAIPVDANTLLAVSGMNGDNTDSQKLNKIISEIQALQEVVARFRQLRLDATEFACLKCIVTFKAVPTHSGSELRSFRNAAAIAALQDEAQLTLNSYIHTRYPTQPCRFGKLLLLLPALRSISPSTIEEVFFKKTIGNVPITRLLSDMYKSSDI

SEQ ID NO: 3206 - protein, 777 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 3207 - protein, 777 aa, Homo sapiens; identical to SEQ ID NO: 3206

SEQ ID NO: 3208 - protein, 777 aa, Homo sapiens; identical to SEQ ID NO: 3206

SEQ ID NO: 3209 - protein, 777 aa, Homo sapiens; identical to SEQ ID NO: 3206

SEQ ID NO: 3210 - protein, 777 aa, Homo sapiens; identical to SEQ ID NO: 3206

SEQ ID NO: 3211 - protein, 742 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHENVMWLKPESTSHTLI

SEQ ID NO: 3212 - protein, 778 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGRQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 3213 - protein, 340 aa, Homo sapiens
MLTQLKAKSEGKLAKQICKVVLDHFEKQYSKELGDAWNTVREILTSPSCWQYAVLLNRFNYPFELEKDLHLKGYHTLSQGSLPNYPKSVKCYLSRTPGRIPSERHQIGNLKKYYLLNAASLLPVLALELRDGEKVLDLCAAPGGKSIALLQCACPGYLHCNEYDSLRLRWLRQTLESFIPQPLINVIKVSELDGRKMGDAQPEMFDKVLVDAPCSNDRSWLFSSDSQKASCRISQRRNLPLLQIELLRSAIKALRPGGILVYSTCTLSKAENQDVISEILNSHGNIMPMDIKGIARTCSHDFTFAPTGQECGLLVIPDKGKAWGPMYVAKLKKSWSTGKW

SEQ ID NO: 3214 - protein, 228 aa, Homo sapiens
MVKSSLQRILNSHCFAREKEGDKPSATIHASRTMPLLSLHSRGGSSSESSRVSLHCCSNPGPGPRWCSDAPHPPLKIPGGRGNSQRDHNLSANLFYSDDRLNVTEELTSNDKTRILNVQSRLTDAKRINWRTVLSGGSLYIEIPGGALPEGSKDSFAVLLEFAEEQLRADHVFICFHKNREDRAALLRTFSFLGFEIVRPGHPLVPKRPDACFMAYTFERESSGEEEE

SEQ ID NO: 3215 - protein, 461 aa, Homo sapiens
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 3216 - protein, 135 aa, Homo sapiens
MPGRWRWQRDMHPARKLLSLLFLILMGTELTQVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKG

SEQ ID NO: 3217 - protein, 758 aa, Homo sapiens
MSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPIDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 3218 - protein, 189 aa, Homo sapiens
MASKRALVILAKGAEEMETVIPVDVMRRAGIKVTVAGLAGKDPVQCSRDVVICPDASLEDAKKEGPYDVVVLPGGNLGAQNLSESAAVKEILKEQENRKGLIAAICAGPTALLAHEIGFGSKVTTHPLAKDKMMNGGHYTYSENRVEKDGLILTSRGPGTSFEFALAIVEALNGKEVAAQVKAPLVLKD

SEQ ID NO: 3219 - protein, 256 aa, Homo sapiens
MATQRKHLVKDFNPYITCYICKGYLIKPTTVTECLHTFCKTCIVQHFEDSNDCPRCGNQVHETNPLEMLRLDNTLEEIIFKLVPGLREQELERESEFWKKNKPQENGQDDTSKADKPKVDEEGDENEDDKDYHRSDPQIAICLDCLRNNGQSGDNVVKGLMKKFIRCSTRVTVGTIKKFLSLKLKLPSSYELDVLCNGEIMGKDHTMEFIYMTRWRLRGENFRCLNCSASQVCSQDGPLYQSYPMVLQYRPRIDFG

SEQ ID NO: 3220 - protein, 469 aa, Homo sapiens
MDVENEQILNVNPADPDNLSDSLFSGDEENAGTEEIKNEINGNWISASSINEARINAKAKRRLRKNSSRDSGRGDSVSDSGSDALRSGLTVPTSPKGRLLDRRSRSGKGRGLPKKGGAGGKGVWGTPGQVYDVEEVDVKDPNYDDDQENCVYETVVLPLDERAFEKTLTPIIQEYFEHGDTNEVAEMLRDLNLGEMKSGVPVLAVSLALEGKASHREMTSKLLSDLCGTVMSTTDVEKSFDKLLKDLPELALDTPRAPQLVGQFIARAVGDGILCNTYIDSYKGTVDCVQARAALDKATVLLSMSKGGKRKDSVWGSGGGQQSVNHLVKEIDMLLKEYLLSGDISEAEHCLKELEVPHFHHELVYEAIIMVLESTGESTFKMILDLLKSLWKSSTITVDQMKRGYERIYNEIPDINLDVPHSYSVLERFVEECFQAGIISKQLRDLCPSRGRKRFVSEGDGGRLKPESY

SEQ ID NO: 3221 - protein, 458 aa, Homo sapiens
MTKYPDNLSDSLFSGDEENAGTEEIKNEINGNWISASSINEARINAKAKRRLRKNSSRDSGRGDSVSDSGSDALRSGLTVPTSPKGRLLDRRSRSGKGRGLPKKGGAGGKGVWGTPGQVYDVEEVDVKDPNYDDDQENCVYETVVLPLDERAFEKTLTPIIQEYFEHGDTNEVAEMLRDLNLGEMKSGVPVLAVSLALEGKASHREMTSKLLSDLCGTVMSTTDVEKSFDKLLKDLPELALDTPRAPQLVGQFIARAVGDGILCNTYIDSYKGTVDCVQARAALDKATVLLSMSKGGKRKDSVWGSGGGQQSVNHLVKEIDMLLKEYLLSGDISEAEHCLKELEVPHFHHELVYEAIIMVLESTGESTFKMILDLLKSLWKSSTITVDQMKRGYERIYNEIPDINLDVPHSYSVLERFVEECFQAGIISKQLRDLCPSRGRKRFVSEGDGGRLKPESY

SEQ ID NO: 3222 - protein, 140 aa, Homo sapiens
MAGWQSYVDNLMCDGCCQEAAIVGYCDAKYVWAATAGGVFQSITPIEIDMIVGKDREGFFTNGLTLGAKKCSVIRDSLYVDGDCTMDIRTKSQGGEPTYNVAVGRAGRALVIVMGKEGVHGGTLNKKAYELALYLRRSDV

SEQ ID NO: 3223 - protein, 140 aa, Homo sapiens
MAGWQSYVDNLMCDGCCQEAAIVGYCDAKYVWAATAGGVFQSITPIEIDMIVGKDREGFFTNGLTLGAKKCSVIRDSLYVDGDCTMDIRTKSQGGEPTYNVAVGRAGRVLVFVMGKEGVHGGGLNKKAYSMAKYLRDSGF

SEQ ID NO: 3224 - protein, 559 aa, Homo sapiens
MAASEDGSGCLVSRGRSQSDPSVLTDSSATSSADAGENPDEMDQTPPARPEYLVSGIRTPPVRRNSKLATLGRIFKPWKWRKKKNEKLKQTTSALEKKMAGRQGREELIKKGLLEMMEQDAESKTCNPDGGPRSVQSEPPTPKSETLTSEDAQPGSPLATGTDQVSLDKPLSSAAHLDDAAKMPSASSGEEADAGSLLPTTNELSQALAGADSLDSPPRPLERSVGQLPSPPLLPTPPPKASSKTTKNVTGQATLFQASSMKSADPSLRGQLSTPTGSPHLTTVHRPLPPSRVIEELHRALATKHRQDSFQGRESKGSPKKRLDVRLSRTSSVERGKEREEAWSFDGALENKRTAAKESEENKENLIINSELKDDLLLYQDEEALNDSIISGTLPRKCKKELLAVKLRNRPSKQELEDRNIFPRRTDEERQEIRQQIEMKLSKRLSQRPAVEELERRNILKQRNDQTEQEERREIKQRLTRKLNQRPTVDELRDRKILIRFSDYVEVAKAQDYDRRADKPWTRLSAADKAAIRKELNEYKSNEMEVHASSKHLTRFHRP

SEQ ID NO: 3225 - protein, 518 aa, Homo sapiens
MDQTPPARPEYLVSGIRTPPVRRNSKLATLGRIFKPWKWRKKKNEKLKQTTSALEKKMAGRQGREELIKKGLLEMMEQDAESKTCNPDGGPRSVQSEPPTPKSETLTSEDAQPGSPLATGTDQVSLDKPLSSAAHLDDAAKMPSASSGEEADAGSLLPTTNELSQALAGADSLDSPPRPLERSVGQLPSPPLLPTPPPKASSKTTKNVTGQATLFQASSMKSADPSLRGQLSTPTGSPHLTTVHRPLPPSRVIEELHRALATKHRQDSFQGRESKGSPKKRLDVRLSRTSSVERGKEREEAWSFDGALENKRTAAKESEENKENLIINSELKDDLLLYQDEEALNDSIISGTLPRKCKKELLAVKLRNRPSKQELEDRNIFPRRTDEERQEIRQQIEMKLSKRLSQRPAVEELERRNILKQRNDQTEQEERREIKQRLTRKLNQRPTVDELRDRKILIRFSDYVEVAKAQDYDRRADKPWTRLSAADKAAIRKELNEYKSNEMEVHASSKHLTRFHRP

SEQ ID NO: 3226 - protein, 448 aa, Homo sapiens
MDQTPPARPEYLVSGIRTPPVRRNSKLATLGRIFKPWKWRKKKNEKLKQTTSALEKKMAGRQGREELIKKGLLEMMEQDAESKTCNPDGGPRSVQSEPPTPKSETLTSEDAQPGSPLATGTDQVSLDKPLSSAAHLDDAGQATLFQASSMKSADPSLRGQLSTPTGSPHLTTVHRPLPPSRVIEELHRALATKHRQDSFQGRESKGSPKKRLDVRLSRTSSVERGKEREEAWSFDGALENKRTAAKESEENKENLIINSELKDDLLLYQDEEALNDSIISGTLPRKCKKELLAVKLRNRPSKQELEDRNIFPRRTDEERQEIRQQIEMKLSKRLSQRPAVEELERRNILKQRNDQTEQEERREIKQRLTRKLNQRPTVDELRDRKILIRFSDYVEVAKAQDYDRRADKPWTRLSAADKAAIRKELNEYKSNEMEVHASSKHLTRFHRP

SEQ ID NO: 3227 - protein, 948 aa, Homo sapiens
MDRSSKRRQVKPLAASLLEALDYDSSDDSDFKVGDASDSEGSGNGSEDASKDSGEGSCSDSEENILEEELNEDIKVKEEQLKNSAEEEVLSSEKQLIKMEKKEEEENGERPRKKKEKEKEKEKEKEKEKEREKEKEKATVSENVAASAAATTPATSPPAVNTSPSVPTTTTATEEQVSEPKKWNLRRNRPLLDFVSMEELNDMDDYDSEDDNDWRPTVVKRKGRSASQKEGSDGDNEDDEDEGSGSDEDENDEGNDEDHSSPASEGGCKKKKSKVLSRNSADDEELTNDSLTLSQSKSNEDSLILEKSQNWSSQKMDHILICCVCLGDNSEDADEIIQCDNCGITVHEGCYGVDGESDSIMSSASENSTEPWFCDACKCGVSPSCELCPNQDGIFKETDAGRWVHIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRCDECRLCYHFGCLDPPLKKSPKQTGYGWICQECDSSSSKEDENEAERKNISQELNMEQKNPKK

SEQ ID NO: 3228 - protein, 888 aa, Homo sapiens
MDRSSKRRQVKPLAASLLEALDYDSSDDSDFKVGDASDSEGSGNGSEDASKDSGEGSCSDSEENILEEELNEDIKVKEEQLKNSAEEEVLSSEKQLIKMEKKEEEENGERPRKKKEKEKEKEKEKEKEKEREKEKEKATVSENVAASAAATTPATSPPAVNTSPSVPTTTTATEEQVSEPKKWNLRRNRPLLDFVSMEELNDMDDYDSEDDNDWRPTVVKRKGRSASQKEGSDGDNEDDEDEGSGSDEDENDEGNDEDHSSPASEGGCKKKKSKVLSRNSADDEELTNDSLTLSQSKSNEDSLILEKSQNWSSQKMDHILICCVCLGDNSEDADEIIQCDNCGITVHEGCYGVDGESDSIMSSASENSTEPWFCDACKCGVSPSCELCPNQDGIFKETDAGRWVHIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRYPS

SEQ ID NO: 3229 - protein, 531 aa, Homo sapiens
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 3230 - protein, 531 aa, Homo sapiens
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAMFHRKLFEELVRASSHSTDLMEAMAMGSVEASYKCLAAALIVLTESGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 3231 - protein, 531 aa, Homo sapiens; identical to SEQ ID NO: 3230

SEQ ID NO: 3232 - protein, 529 aa, Homo sapiens
MARFPKADLAAAGVMLLCHFFTDQFQFADGKPGDQILDWQYGVTQAFPHTEEEVEVDSHAYSHRWKRNLDFLKAVDTNRASVGQDSPEPRSFTDLLLDDGQDNNTQIEEDTDHNYYISRIYGPSDSASRDLWVNIDQMEKDKVKIHGILSNTHRQAARVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTVGATTTQFRVLTTTRRAVTSQFPTSLPTEDDTKIALHLKDNGASTDDSAAEKKGGTLHAGLIIGILILVLIVATAILVTVYMYHHPTSAASIFFIERRPSRWPAMKFRRGSGHPAYAEVEPVGEKEGFIVSEQC

SEQ ID NO: 3233 - protein, 1133 aa, Homo sapiens
MDVLAEEFGNLTPEQLAAPIPTVEEKWRLLPAFLKVKGLVKQHIDSFNYFINVEIKKIMKANEKVTSDADPMWYLKYLNIYVGLPDVEESFNVTRPVSPHECRLRDMTYSAPITVDIEYTRGSQRIIRNALPIGRMPIMLRSSNCVLTGKTPAEFAKLNECPLDPGGYFIVKGVEKVILIQEQLSKNRIIVEADRKGAVGASVTSSTHEKKSRTNMAVKQGRFYLRHNTLSEDIPIVIIFKAMGVESDQEIVQMIGTEEHVMAAFGPSLEECQKAQIFTQMQALKYIGNKVRRQRMWGGGPKKTKIEEARELLASTILTHVPVKEFNFRAKCIYTAVMVRRVILAQGDNKVDDRDYYGNKRLELAGQLLSLLFEDLFKKFNSEMKKIADQVIPKQRAAQFDVVKHMRQDQITNGMVNAISTGNWSLKRFKMDRQGVTQVLSRLSYISALGMMTRISSQFEKTRKVSGPRSLQPSQWGMLCPSDTPEGEACGLVKNLALMTHITTDMEDGPIVKLASNLGVEDVNLLCGEELSYPNVFLVFLNGNILGVIRDHKKLVNTFRLMRRAGYINEFVSISTNLTDRCVYISSDGGRLCRPYIIVKKQKPAVTNKHMEELAQGYRNFEDFLHESLVEYLDVNEENDCNIALYEHTINKDTTHLEIEPFTLLGVCAGLIPYPHHNQSPRNTYQCAMGKQAMGTIGYNQRNRIDTLMYLLAYPQKPMVKTKTIELIEFEKLPAGQNATVAVMSYSGYDIEDALVLNKASLDRGFGRCLVYKNAKCTLKRYTNQTFDKVMGPMLDAATRKPIWRHEILDADGICSPGEKVENKQVLVNKSMPTVTQIPLEGSNVPQQPQYKDVPITYKGATDSYIEKVMISSNAEDAFLIKMLLRQTRRPEIGDKFSSRHGQKGVCGLIVPQEDMPFCDSGICPDIIMNPHGFPSRMTVGKLIELLAGKAGVLDGRFHYGTAFGGSKVKDVCEDLVRHGYNYLGKDYVTSGITGEPFEAYIYFGPVYYQKLKHMVLDKMHARARGPRAVLTRQPTEGRSRDGGLRLGEMERDCLIGYGASMLLLERLMISSDAFEVDVCGQCGLLGYSGWCHYCKSSCHVSSLRIPYACKLLFQELQSMNIIPRLKLSKYNE

SEQ ID NO: 3234 - protein, 521 aa, Homo sapiens
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 3235 - protein, 224 aa, Homo sapiens
MPGGLLLGDVAPNFEANTTVGRIRFHDFLGDSWGILFSHPRDFTPVCTTELGRAAKLAPEFAKRNVKLIALSIDSVEDHLAWSKDINAYNCEEPTEKLPFPIIDDRNRELAILLGMLDPAEKDEKGMPVTARVVFVFGPDKKLKLSILYPATTGRNFDEILRVVISLQLTAEKRVATPVDWKDGDSVMVLPTIPEEEAKKLFPKGVFTKELPSGKKYLRYTPQP

SEQ ID NO: 3236 - protein, 831 aa, Homo sapiens
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEALGRGTIKLLSRAVMHAVCEQCGLKINGGEVAVFASRAGPGVCWHPSCFVCFTCNELLVDLIYFYQDGKIHCGRHHAELLKPRCSACDEIIFADECTEAEGRHWHMKHFCCLECETVLGGQRYIMKDGRPFCCGCFESLYAEYCETCGEHIGVDHAQMTYDGQHWHATEACFSCAQCKASLLGCPFLPKQGQIYCSKTCSLGEDVHASDSSDSAFQSARSRDSRRSVRMGKSSRSADQCRQSLLLSPALNYKFPGLSGNADDTLSRKLDDLSLSRQGTSFASEEFWKGRVEQETPEDPEEWADHEDYMTQLLLKFGDKSLFQPQPNEMDIRASEHWISDNMVKSKTELKQNNQSLASKKYQSDMYWAQSQDGLGDSAYGSHPGPASSRRLQELELDHGASGYNHDETQWYEDSLECLSDLKPEQSVRDSMDSLALSNITGASVDGENKPRPSLYSLQNFEEMETEDCEKMSNMGTLNSSMLHRSAESLKSLSSELCPEKILPEEKPVHLPVLRRSKSQSRPQQVKFSDDVIDNGNYDIEIRQPPMSERTRRRVYNFEERGSRSHHHRRRRSRKSRSDNALNLVTERKYSPKDRLRLYTPDNYEKFIQNKSAREIQAYIQNADLYGQYAHATPDYGLQNPGMNRFLGLYGEDDDSWCSSSSSSSDSEEEGYFLGQPIPQPRPQRFAYYTDDLSSPPSALPTPQFGQRTTKSKKKKGHKGKNCIIS

SEQ ID NO: 3237 - protein, 351 aa, Homo sapiens
MGNAAAAKKGSEQESVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 3238 - protein, 343 aa, Homo sapiens
MASNSSDVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 3239 - protein, 525 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEVQGEQPKPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTEPSRCEYLMELMTPAACPEPPPEAPTEDDHDEL

SEQ ID NO: 3240 - protein, 528 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTEPSRCEYLMELMTPAACPEPPPEAPTEDDHDEL

SEQ ID NO: 3241 - protein, 318 aa, Homo sapiens
MPNIKIFSGSSHQDLSQKIADRLGLELGKVVTKKFSNQETCVEIGESVRGEDVYIVQSGCGEINDNLMELLIMINACKIASASRVTAVIPCFPYARQDKKDKSRAPISAKLVANMLSVAGADHIITMDLHASQIQGFFDIPVDNLYAEPAVLKWIRENISEWRNCTIVSPDAGGAKRVTSIADRLNVDFALIHKERKKANEVDRMVLVGDVKDRVAILVDDMADTCGTICHAADKLLSAGATRVYAILTHGIFSGPAISRINNACFEAVVVTNTIPQEDKMKHCSKIQVIDISMILAEAIRRTHNGESVSYLFSHVPL

SEQ ID NO: 3242 - protein, 530 aa, Homo sapiens
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEQQNKDEGKKPEVKKVEKKRETSMDSRLQRIHAEIKNSLKIDNLDVNRCIEALDELASLQVTMQQAQKHTEMITTLKKIRRFKVSQVIMEKSTMLYNKFKNMFLVGEGDSVITQVLNKSLAEQRQHEEANKTKDQGKKGPNKKLEKEQTGSKTLNGGSDAQDGNQPQHNGESNEDSKDNHEASTKKKPSSEERETEISLKDSTLDN

SEQ ID NO: 3243 - protein, 349 aa, Homo sapiens
MSSLSGKVQTVLGLVEPSKLGRTLTHEHLAMTFDCCYCPPPPCQEAISKEPIVMKNLYWIQKNAYSHKENLQLNQETEAIKEELLYFKANGGGALVENTTTGISRDTQTLKRLAEETGVHIISGAGFYVDATHSSETRAMSVEQLTDVLMNEILHGADGTSIKCGIIGEIGCSWPLTESERKVLQATAHAQAQLGCPVIIHPGRSSRAPFQIIRILQEAGADISKTVMSHLDRTILDKKELLEFAQLGCYLEYDLFGTELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 3244 - protein, 349 aa, Homo sapiens; identical to SEQ ID NO: 3243

SEQ ID NO: 3245 - protein, 593 aa, Homo sapiens [sequence omitted]

SEQ ID NO: 3246 - protein, 180 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 3247 - protein, 322 aa, Homo sapiens
MADRDSGSEQGGAALGSGGSLGHPGSGSGSGGGGGGGGGGGGSGGGGGGAPGGLQHETQELASKRVDIQNKRFYLDVKQNAKGRFLKIAEVGAGGNKSRLTLSMSVAVEFRDYLGDFIEHYAQLGPSQPPDLAQAQDEPRRALKSEFLVRENRKYYMDLKENQRGRFLRIRQTVNRGPGLGSTQGQTIALPAQGLIEFRDALAKLIDDYGVEEEPAELPEGTSLTVDNKRFFFDVGSNKYGVFMRVSEVKPTYRNSITVPYKVWAKFGHTFCKYSEEMKKIQEKQREKRAACEQLHQQQQQQQEETAAATLLLQGEEEGEED

SEQ ID NO: 3248 - protein, 219 aa, Homo sapiens
MASVTDGKTGVKDASDQNFDYMFKLLIIGNSSVGKTSFLFRYADDTFTPAFVSTVGIDFKVKTVYRHEKRVKLQIWDTAGQERYRTITTAYYRGAMGFILMYDITNEESFNAVQDWATQIKTYSWDNAQVILVGNKCDMEEERVVPTEKGQLLAEQLGFDFFEASAKENISVRQAFERLVDAICDKMSDSLDTDPSMLGSSKNTRLSDTPPLLQQNCSC

SEQ ID NO: 3249 - protein, 213 aa, Homo sapiens
MAAAASPAFLLRLPLLLLLSSWCRTGLADPHSLCYDITVIPKFRPGPRWCAVQGQVDEKTFLHYDCGSKTVTPVSPLGKKLNVTTAWKAQNPVLREVVDILTEQLLDIQLENYIPKEPLTLQARMSCEQKAEGHGSGSWQLSFDGQIFLLFDSENRMWTTVHPGARKMKEKWENDKDMTMSFHYISMGDCTGWLEDFLMGMDSTLEPSAGGTV

SEQ ID NO: 3250 - protein, 236 aa, Homo sapiens
MAELVPFAVPIESDKTLLVWELSSGPTAEALHHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEGPLSFLMKRKTAQKLAIQKALSDAFQKLLIVVLGKTVLIILEVLQFQ

SEQ ID NO: 3251 - protein, 181 aa, Homo sapiens
MCKGLAALPHSCLERAKEIKIKLGILLQKPDSVGDLVIPYNEKPEKPAKTQKTSLDEALQWRDSLDKLLQNNYGLASFKSFLKSEFSEENLEFWIACEDYKKIKSPAKMAEKAKQIYEEFIQTEAPKEVNIDHFTKDITMKNLVEPSLSSFDMAQKRIHALMEKDSLPRFVRSEFYQELIK

SEQ ID NO: 3252 - protein, 119 aa, Homo sapiens
  VARIANT 56, 114: Xaa = Any Amino Acid
MCRPQEYLMPFFSSCLCPSHYSRPLPSLFNLILPPHRPREPVGLCSPAGYGSSCKXLLCQKCFLASNNRKANTSFINNNIGGLLKVSRDGGEQDWFPPQCQGLKDSFCGRATSXTLYPV

SEQ ID NO: 3253 - protein, 119 aa, Homo sapiens; identical to SEQ ID NO: 3252
  VARIANT 56, 114: Xaa = Any Amino Acid

SEQ ID NO: 3254 - protein, 1039 aa, Homo sapiens
MQSRLLLLGAPGGHGGPASRRMRLLLRQVVQRRPGGDRQRPEVRLLHAGSGADTGDTVNIGDVSYKLKIPKNPELVPQNYISDSLAQSVVQHLRWIMQKDLLGQDVFLIGPPGPLRRSIAMQYLELTKREVEYIALSRDTTETDLKQRREIRAGTAFYIDQCAVRAATEGRTLILEGLEKAERNVLPVLNNLLENREMQLEDGRFLMSAERYDKLLRDHTKKELDSWKIVRVSENFRVIALGLPVPRYSGNPLDPPLRSRFQARDIYYLPFKDQLKLLYSIGANVSAEKVSQLLSFATTLCSQESSTLGLPDFPLDSLAAAVQILDSFPMMPIKHAIQWLYPYSILLGHEGKMAVEGVLKRFELQDSGSSLLPKEIVKVEKMMENHVSQASVTIRIADKEVTIKVPAGTRLLSQPCASDRFIQTLSHKQLQAEMMQSHMVKDICLIGGKGCGKTVIAKNFADTLGYNIEPIMLYQDMTARDLLQQRYTLPNGDTAWRSSPLVNAALEGKLVLLDGIHRVNAGTLAVLQRLIHDRELSLYDGSRLLREDRYMRLKEELQLSDEQLQKRSIFPIHPSFRIIALAEPPVIGSTAHQWLGPEFLTMFFFHYMKPLVKSEEIQVIKEKVPNVPQEALDKLLSFTHKLRETQDPTAQSLAASLSTRQLLRISRRLSQYPNENLHSAVTKACLSRFLPSLARSALEKNLADATIEINTDDNLEPELKDYKCEVTSGTLRIGAVSAPIYNAHEKMKVPDVLFYDNIQHVIVMEDMLKDFLLGEHLLLVGNQGVGKNKIVDRFLHLLNRPREYIQLHRDTTVQTLTLQPSVKDGLIVYEDSPLVKAVKLGHILVVDEADKAPTNVTCILKTLVENGEMILADGRRIVANSANVNGRENVVVIHPDFRMIVLANRPGFPFLGNDFFGTLGDIFSCHAVDNPKPHSELEMLRQYGPNVPEPILQKLVAAFGELRSLADQGIINYPYSTREVVNIVKHLQKFPTEGLSSVVRNVFDFDSYNNDMREILINTLHKYGIPIGAKPTSVQLAKE

SEQ ID NO: 3255 - protein, 1905 aa, Homo sapiens
MQSRLLLLGAPGGHGGPASRRMRLLLRQVVQRRPGGDRQRPEVRLLHAGSGADTGDTVNIGDVSYKLKIPKNPELVPQNYISDSLAQSVVQHLRWIMQKDLLGQDVFLIGPPGPLRRSIAMQYLELTKREVEYIALSRDTTETDLKQRREIRAGTAFYIDQCAVRAATEGRTLILEGLEKAERNVLPVLNNLLENREMQLEDGRFLMSAERYDKLLRDHTKKELDSWKIVRVSENFRVIALGLPVPRYSGNPLDPPLRSRFQARDIYYLPFKDQLKLLYSIGANVSAEKVSQLLSFATTLCSQESSTLGLPDFPLDSLAAAVQILDSFPMMPIKHAIQWLYPYSILLGHEGKMAVEGVLKRFELQDSGSSLLPKEIVKVEKMMENHVSQASVTIRIADKEVTIKVPAGTRLLSQPCASDRFIQTLSHKQLQAEMMQSHMVKDICLIGGKGCGKTVIAKNFADTLGYNIEPIMLYQDMTARDLLQQRYTLPNGDTAWRSSPLVNAALEGKLVLLDGIHRVNAGTLAVLQRLIHDRELSLYDGSRLLREDRYMRLKEELQLSDEQLQKRSIFPIHPSFRIIALAEPPVIGSTAHQWLGPEFLTMFFFHYMKPLVKSEEIQVIKEKVPNVPQEALDKLLSFTHKLRETQDPTAQSLAASLSTRQLLRISRRLSQYPNENLHSAVTKACLSRFLPSLARSALEKNLADATIEINTDDNLEPELKDYKCEVTSGTLRIGAVSAPIYNAHEKMKVPDVLFYDNIQHVIVMEDMLKDFLLGEHLLLVGNQGVGKNKIVDRFLHLLNRPREYIQLHRDTTVQTLTLQPSVKDGLIVYEDSPLVKAVKLGHILVVDEADKAPTNVTCILKTLVENGEMILADGRRIVANSANVNGRENVVVIHPDFRMIVLANRPGFPFLGNDFFGTLGDIFSCHAVDNPKPHSELEMLRQYGPNVPEPILQKLVAAFGELRSLADQGIINYPYSTREVVNIVKHLQKFPTEGLSSVVRNVFDFDSYNNDMREILINTLHKYGIPIGAKPTSVQLAKELTLPEQTFMGYWTIGQARSGMQKLLCPVETHHIDIKGPALINIQEYPIERHEERSLNFTEECASWRIPLDEINIICDIATSHENEQNTLYVVTCNPASLYFMNMTGKSGFFVDFFDIFPRTANGVWHPFVTVAPLGSPLKGQVVLHEQQSNVILLLDTTGRALHRLILPSEKFTSKKPFWWNKEEAETYKMCKEFSHKNWLVFYKEKGNSLTVLDVLEGRTHTISLPINLKTVFLVAEDKWLLVESKTNQKYLLTKPAHIESEGSGVCQLYVLKEEPPSTGFGVTQETEFSIPHKISSDQLSSEHLSSAVEQKIASPNRILSDEKNYATIVVGFPDLMSPSEVYSWKRPSSLHKRSGTDTSFYRGKKKRGTPKQSNCVTLLDTNQVVRILPPGEVPLKDIYPKDVTPPQTSGYIEVTDLQSKKLRYIPIPRSESLSPYTTWLSTISDTDALLAEWDKSGVVTVDMGGHIRLWETGLERLQRSLMEWRNMIGQDDRNMQITINRDSGEDVSSPKHGKEDPDNMPHVGGNTWAGGTGGRDTAGLGGKGGPYRLDAGHTVYQVSQAEKDAVPEEVKRAAREMGQRAFQQRLKEIQMSEYDAATYERFSGAVRRQVHSLRIILDNLQAKGKERQWLRHQATGELDDAKIIDGLTGEKAIYKRRGELEPQLGSPQQKPKRLRLVVDVSGSMYRFNRMDGRLERTMEAVCMVMEAFENYEEKFQYDIVGHSGDGYNIGLVPMNKIPKDNKQRLEILKTMHAHSQFCMSGDHTLEGTEHAIKEIVKEEADEYFVIVLSDANLSRYGIHPAKFAQILTRDPQVNAFAIFIGSLGDQATRLQRTLPAGRSFVAMDTKDIPQILQQIFTSTMLSSV

SEQ ID NO: 3256 - protein, 694 aa, Homo sapiens
MMFRDQVGILAGWFKGWNECEQTVALLSLLKRVTRTQARFLQLCLEHSLADCNDIHLLESEANSAAIVSQWQQESKEKVVSLLLSHLPLLQPGNTEAKSEYMRLLQKVLAYSIESNAFIEESRQLLSYALIHPATTLEDRNALALWLSHLEERLASGFRSRPEPSYHSRQGSDEWGGPAELGPGEAGPGWQDKPPRENGHVPFHPSSSVPPAINSIGSNANTGLPCQIHPSPLKRSMSLIPTSPQVPGEWPSPEELGARAAFTTPDHAPLSPQSSVASSGSEQTEEQGSSRNTFQEDGSGMKDVPSWLKSLRLHKYAALFSQMSYEEMMTLTEQHLESQNVTKGARHKIALSIQKLRERQSVLKSLEKDVLEGGNLRNALQELQQIIITPIKAYSVLQATVAAATTTPTAKDGAPGEPPLPGAEPPLAHPGTDKGTEAKDPPAVENYPPPPAPAPTDGSEPAPAPVADGDIPSQFTRVMGKVCTQLLVSRPDEENITSYLQLIEKCLTHEAFTETQKKRLLSWKQQVLKLLRTFPRKAALEMQNYRQQKGWAFGSNSLPIAGSVGMGVARRTQRQFPMPPRALPPGRMGLLSPSGIGGVSPRHALTSPSLGGQGRQNLWFANPGGSNSMPSQSRSSVQRTHSLPVHSSPQAILMFPPDCPVPGPDLEINPTLESLCLSMTEHALGDGTDKTSTI

SEQ ID NO: 3257 - protein, 1024 aa, Homo sapiens
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKVNQDSFEHALEVAEAAAETSLEGGNMALAIFIPVLIISLLLGGAYIYITRCRYYSNLRLPLMYSHPYSQITVETEFDNPIYETGETREYEVSI

SEQ ID NO: 3258 - protein, 125 aa, Homo sapiens
MAMQAAKRANIRLPPEVNRILYIRNLPYKITAEEMYDIFGKYGPIRQIRVGNTPETRGTAYVVYEDIFDAKNACDHLSGFNVCNRYLVVLYYNANRAFQKMDTKKKEEQLKLLKEKYGINTDPPK

SEQ ID NO: 3259 - protein, 1105 aa, Homo sapiens
MLAYCVQDATVVDVEKRRNPSKHYVYIINVTWSDSTSQTIYRRYSKFFDLQMQLLDKFPIEGGQKDPKQRIIPFLPGKILFRRSHIRDVAVKRLKPIDEYCRALVRLPPHISQCDEVFRFFEARPEDVNPPKEDYGSSKRKSVWLSSWAESPKKDVTGADATAEPMILEQYVVVSNYKKQENSELSLQAGEVVDVIEKNESGWWFVSTSEEQGWVPATYLEAQNGTRDDSDINTSKTGEEEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPQSVFVSPPPKDNNLSCALRRNESLTATDGLRGVRRNSSFSTARSAAAEAKGRLAERAASQGSDSPLLPAQRNSIPVSPVRPKPIEKSQFIHNNLKDVYVSIADYEGDEETAGFQEGVSMEVLERNPNGWWYCQILDGVKPFKGWVPSNYLEKKN

SEQ ID NO: 3260 - protein, 310 aa, Homo sapiens
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKEKLNDVFDPDSTQVHMISAAMAGFTAITATNPIWLIKTRLQLDARNRGERRMGAFECVRKVYQTDGLKGFYRGMSASYAGISETVIHFVIYESIKQKLLEYKTASTMENGEESVKEASDFVGMMLAAATSKTCATTIAYPHVVRTRLREEGTKYRSFFQTLSLLVQEEGYGSLYRGLTTHLVRQIPNTAIMMATYELVVYLLNG

SEQ ID NO: 3261 - protein, 461 aa, Homo sapiens
MGTIHLFRKPQRSFFGKLLREFRLVAADRRSWKILLFGVINLICTGFLLMWCSSTNSIALTAYTYLTIFDLFSLMTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGKVLLQTTPPHVIGQLDKLIREVSTLDGVLEVRNEHFWTLGFGSLAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 3262 - protein, 523 aa, Homo sapiens
MVPPRRHRGAGRPGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVWFLANLSYQEALSDTQVAIVNILSSTSGLFTLILAAVFPSNSGDRFTLSKLLAVILSIGGVVLVNLAGSEKPAGRDTVGSIWSLAGAMLYAVYIVMIKRKVDREDKLDIPMFFGFVGLFNLLLLWPGFFLLHYTGFEDFEFPNKVVLMCIIINGLIGTVLSEFLWLWGCFLTSSLIGTLALSLTIPLSIIADMCMQKVQFSWLFFAGAIPVFFSFFIVTLLCHYNNWDPVMVGIRRIFAFICRKHRIQRVPEDSEQCESLISMHSVSQEDGAS

SEQ ID NO: 3263 - protein, 483 aa, Homo sapiens
MSVTKSTEGPQGAVAIKLDLMSPPESAKKLENKDSTFLDESPSESAGLKKTKGITVFQALIHLVKGNMGTGILGLPLAVKNAGILMGPLSLLVMGFIACHCMHILVKCAQRFCKRLNKPFMDYGDTVMHGLEANPNAWLQNHAHWGRHIVSFFLINTQLGFCCVYIVFLADNLKQVVEAVNSTTNNCYSNETVILTPTMDSRLYMLSFLPFLVLLVLIRNLRILTIFSMLANISMLVSLVIIIQYITQEIPDPSRLPLVASWKTYPLFFGTAIFSFESIGVVLPLENKMKNARHFPAILSLGMSIVTSLYIGMAALGYLRFGDDIKASISLNLPNCWLYQSVKLLYIAGILCTYALQFYVPAEIIIPFAISRVSTRWALPLDLSIRLVMVCLTCLLAILIPRLDLVIPLVGSVSGTALALIIPPLLEVTTFYSEGMSPLTIFKDALISILGFVGFVVGTYQALDELLKSEDSHPFSNSTTFVR

SEQ ID NO: 3264 - protein, 675 aa, Homo sapiens
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 3265 - protein, 425 aa, Homo sapiens
MSSILPFTPPIVKRLLGWKKGEQNGQEEKWCEKAVKSLVKKLKKTGQLDELEKAITTQNVNTKCITIPRSLDGRLQVSHRKGLPHVIYCRLWRWPDLHSHHELRAMELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 3266 - protein, 1052 aa, Homo sapiens
MSSAAEPPPPPPPESAPSKPAASIASGGSNSSNKGGPEGVAAQAVASAVSAGPADAEMEEIFDDASPGKQKEIQEPDPTYEEKMQTDRANRFEYLLKQTELFAHFIQPAAQKTPTSPLKMKPGRPRIKKDEKQNLLSVGDYRHRRTEQEEDEELLTESSKATNVCTRFEDSPSYVKWGKLRDYQVRGLNWLISLYENGINGILADEMGLGKTLQTISLLGYMKHYRNIPGPHMVLVPKSTLHNWMSEFKRWVPTLRSVCLIGDKEQRAAFVRDVLLPGEWDVCVTSYEMLIKEKSVFKKFNWRYLVIDEAHRIKNEKSKLSEIVREFKTTNRLLLTGTPLQNNLHELWSLLNFLLPDVFNSADDFDSWFDTNNCLGDQKLVERLHMVLRPFLLRRIKADVEKSLPPKKEVKIYVGLSKMQREWYTRILMKDIDILNSAGKMDKMRLLNILMQLRKCCNHPYLFDGAEPGPPYTTDMHLVTNSGKMVVLDKLLPKLKEQGSRVLIFSQMTRVLDILEDYCMWRNYEYCRLDGQTPHDERQDSINAYNEPNSTKFVFMLSTRAGGLGINLATADVVILYDSDWNPQVDLQAMDRAHRIGQTKTVRVFRFITDNTVEERIVERAEMKLRLDSIVIQQGRLVDQNLNKIGKDEMLQMIRHGATHVFASKESEITDEDIDGILERGAKKTAEMNEKLSKMGESSLRNFTMDTESSVYNFEGEDYREKQKIAFTEWIEPPKRERKANYAVDAYFREALRVSEPKAPKAPRPPKQPNVQDFQFFPPRLFELLEKEILFYRKTIGYKVPRNPELPNAAQAQKEEQLKIDEAESLNDEELEEKEKLLTQGFTNWNKRDFNQFIKANEKWGRDDIENIAREVEGKTPEEVIEYSAVFWERCNELQDIEKIMAQIERGEARIQRRISIKKALDTKIGRYKAPFHQLRISYGTNKGKNYTEEEDRFLICMLHKLGFDKENVYDELRQCIRNSPQFRFDWFLKSRTAMELQRRCNTLITLIERENMELEEKEKAEKKKRGPKPSTQKRKMDGAPDGRGRKKKLKL

SEQ ID NO: 3267 - protein, 1214 aa, Homo sapiens
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVAGNAPLGLPFGMPPPPPPPAPSIIPFGSLADSISINLPAPPNLHGHHHHLPFAPGTLPPPNLPVSMANPLHPNLPATTTMPSSLPLGPGLGSAAAQSPAIVAAVQGNLLPSASPLPDPGTPLPPDPTAPSPGTVTPVPPPQ

SEQ ID NO: 3268 - protein, 1130 aa, Homo sapiens
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQGRQVDADTKAGRKGKELDDLVPETAKGKPELQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVADPGTPLPPDPTAPSPGTVTPVPPPQ

SEQ ID NO: 3269 - protein, 1560 aa, Homo sapiens
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGRLQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 3270 - protein, 907 aa, Homo sapiens
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEQVGIDKGDIPDLTQAPSSLMETLEQHLNTLEGKKPGNNEGSGAPSPLSKSSPATTVTSPNSTPAKTIDTSPPVDLFATASAAVPVSTSKPSSDLLDLQPDFSSGGAAAAAAPAPPPPAGGATAWGDLLGEDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSVDAFAAPSPATTASPAKVDSSGVIDLFGDAFGSSASEPQPASQAASSSSASADLLAGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 3271 - protein, 441 aa, Homo sapiens
MVQQAESLEAESNLPREALDTEEGEFMACSPVALDESDPDWCKTASGHIKRPMNAFMVWSKIERRKIMEQSPDMHNAEISKRLGKRWKMLKDSEKIPFIREAERLRLKHMADYPDYKYRPRKKPKMDPSAKPSASQSPEKSAAGGGGGSAGGGAGGAKTSKGSSKKCGKLKAPAAAGAKAGAGKAAQSGDYGGAGDDYVLGSLRVSGSGGGGAGKTVKCVFLDEDDDDDDDDDELQLQIKQEPDEEDEEPPHQQLLQPPGQQPSQLLRRYNVAKVPASPTLSSSAESPEGASLYDEVRAGATSGAGGGSRLYYSFKNITKQHPPPLAQPALSPASSRSVSTSSSSSSGSSSGSSGEDADDLMFDLSLNFSQSAHSASEQQLGGGAAAGNLSLSLVDKDLDSFSEGSLGSHFEFPDYCTPELSEMIAGDWLEANFSDLVFTY

SEQ ID NO: 3272 - protein, 439 aa, Homo sapiens
MPAIAVLAAAAAAWCFLQVESRHLDALAGGAGPNHGNFLDNDQWLSTVSQYDRDKYWNRFRDDDYFRNWNPNKPFDQALDPSKDPCLKVKCSPHKVCVTQDYQTALCVSRKHLLPRQKKGNVAQKHWVGPSNLVKCKPCPVAQSAMVCGSDGHSYTSKCKLEFHACSTGKSLATLCDGPCPCLPEPEPPKHKAERSACTDKELRNLASRLKDWFGALHEDANRVIKPTSSNTAQGRFDTSILPICKDSLGWMFNKLDMNYDLLLDPSEINAIYLDKYEPCIKPLFNSCDSFKDGKLSNNEWCYCFQKPGGLPCQNEMNRIQKLSKGKSLLGAFIPRCNEEGYYKATQCHGSTGQCWCVDKYGNELAGSRKQGAVSCEEEQETSGDFGSGGSVVLLDDLEYERELGPKDKEGKLRVHTRAVTEDDEDEDDDKEDEVGYIW

SEQ ID NO: 3273 - protein, 2364 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKHLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 3274 - protein, 2155 aa, Homo sapiens
MELQRTSSISGPLSPAYTGQVPYNYNQLEGRFKQLQDEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKHLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRVSYRSQTYQNYKNFNSRRTASDQPWSGL

SEQ ID NO: 3275 - protein, 1071 aa, Homo sapiens
MTSPAKFKKDKEIIAEYDTQVKEIRAQLTEQMKCLDQQCELRVQLLQDLQDFFRKKAEIEMDYSRNLEKLAERFLAKTRSTKDQQFKKDQNVLSPVNCWNLLLNQVKRESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDQCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTKMKEYLEGRNLITKLQAKHDLLQKTLGESQRTDCSLARRSSTVRKQDSSQAIPLVVESCIRFISRHGLQHEGIFRVSGSQVEVNDIKNAFERGEDPLAGDQNDHDMDSIAGVLKLYFRGLEHPLFPKDIFHDLMACVTMDNLQERALHIRKVLLVLPKTTLIIMRYLFAFLNHLSQFSEENMMDPYNLAICFGPSLMSVPEGHDQVSCQAHVNELIKTIIIQHENIFPSPRELEGPVYSRGGSMEDYCDSPHGETTPVEDSTQDVTAEHHTSDDECEPIEAIAKFDYVGRTARELSFKKGASLLLYQRASDDWWEGRHNGIDGLIPHQYIVVQDTEDGVVERSSPKSEIEVISEPPEEKVTARAGASCPSGGHVADIYLANINKQRKRPESGSIRKTFRSDSHGLSSSLTDSSSPGVGASCRPSSQPIMSQSLPKEGPDKCSISGHGSLNSISRHSSLKNRLDSPQIRKTATAGRSKSFNNHRPMDPEVIAQDIEATMNSALNELRELERQSSVKHTPDVVLDTLEPLKTSPVVAPTSEPSSPLHTQLLKDPEPAFQRSASTAGDIACAFRPVKSVKMAAPVKPPATRPKPTVFPKTNATSPGVNSSTSPQSTDKSCTV

SEQ ID NO: 3276 - protein, 688 aa, Homo sapiens
MSVNSEKSSSSERPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 3277 - protein, 699 aa, Homo sapiens
MSSRKVLAIQARKRRPKREKHPKKPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 3278 - protein, 638 aa, Homo sapiens
MLDFFTIFSKGGLVLWCFQGVSDSCTGPVNALIRSVLLQERGGNNSFTHEALTLKYKLDNQFELVFVVGFQKILTLTYVDKLIDDVHRLFRDKYRTEIQQQSALSLLNGTFDFQNDFLRLLREAEESSKIRAPTTMKKFEDSEKAKKPVRSMIETRGEKPKEKAKNSKKKGAKKEGSDGPLATSKPVPAEKSGLPVGPENGVELSKEELIRRKREEFIQKHGRGMEKSNKSTKSDAPKEKGKKAPRVWELGGCANKEVLDYSTPTTNGTPEAALSEDINLIRGTGSGGQLQDLDCSSSDDEGAAQNSTKPSATKGTLGGMFGMLKGLVGSKSLSREDMESVLDKMRDHLIAKNVAADIAVQLCESVANKLEGKVMGTFSTVTSTVKQALQESLVQILQPQRRVDMLRDIMDAQRRQRPYVVTFCGVNGVGKSTNLAKISFWLLENGFSVLIAACDTFRAGAVEQLRTHTRRLSALHPPEKHGGRTMVQLFEKGYGKDAAGIAMEAIAFARNQGFDVVLVDTAGRMQDNAPLMTALAKLITVNTPDLVLFVGEALVGNEAVDQLVKFNRALADHSMAQTPRLIDGIVLTKFDTIDDKVGAAISMTYITSKPIVFVGTGQTYCDLRSLNAKAVVAALMKA

SEQ ID NO: 3279 - protein, 547 aa, Homo sapiens
MAEPSGSPVHVQLPQQAAPVTAAAAAAPAAATAAPAPAAPAAPAPAPAPAPAAQAVGWPICRDAYELQEVIGSGATAVVQAALCKPRQERVAIKRINLEKCQTSMDELLKEIQAMSQCSHPNVVTYYTSFVVKDELWLVMKLLSGGSMLDIIKYIVNRGEHKNGVLEEAIIATILKEVLEGLDYLHRNGQIHRDLKAGNILLGEDGSVQIADFGVSAFLATGGDVTRNKVRKTFVGTPCWMAPEVMEQVRGYDFKADMWSFGITAIELATGAAPYHKYPPMKVLMLTLQNDPPTLETGVEDKEMMKKYGKSFRKLLSLCLQKDPSKRPTAAELLKCKFFQKAKNREYLIEKLLTRTPDIAQRAKKVRRVPGSSGHLHKTEDGDWEWSDDEMDEKSEEGKAAFSQEKSRRVKEENPEIAVSASTIPEQIQSLSVHDSQGPPNANEDYREASSCAVNLVLRLRNSRKELNDIRFEFTPGRDTADGVSQELFSAGLVDGHDVVIVAANLQKIVDDPKALKTLTFKLASGCDGSEIPDEVKLIGFAQLSVS

SEQ ID NO: 3280 - protein, 780 aa, Homo sapiens
MDEQAGPGVFFSNNHPGAGGAKGLGPLAEAAAAGDGAAAAGAARAQYSLPGILHFLQHEWARFEVERAQWEVERAELQAQIAFLQGERKGQENLKKDLVRRIKMLEYALKQERAKYHKLKYGTELNQGDMKPPSYDSDEGNETEVQPQQNSQLMWKQGRQLLRQYLQEVGYTDTILDVKSKRVRALLGFSSDVTDREDDKNQDSVVNGTEAEVKETAMIAKSELTDSASVLDNFKFLESAAADFSDEDEDDDVDGREKSVIDTSTIVRKKALPDSGEDRDTKEALKEFDFLVTSEEGDNESRSAGDGTDWEKEDQCLMPEAWNVDQGVITKLKEQYKKERKGKKGVKRPNRSKLQDMLANLRDVDELPSLQPSVGSPSRPSSSRLPEHEINRADEVEALTFPPSSGKSFIMGADEALESELGLGELAGLTVANEADSLTYDIANNKDALRKTWNPKFTLRSHFDGIRALAFHPIEPVLITASEDHTLKMWNLQKTAPAKKSTSLDVEPIYTFRAHKGPVLCVVMSSNGEQCYSGGTDGLIQGWNTTNPNIDPYDSYDPSVLRGPLLGHTDAVWGLAYSAAHQRLLSCSADGTLRLWNTTEVAPALSVFNDTKELGIPASVDLVSSDPSHMVASFSKGYTSIFNMETQQRILTLESNVDTTANSSCQINRVISHPTLPISITAHEDRHIKFYDNNTGKLIHSMVAHLEAVTSLAVDPNGLYLMSGSHDCSIRLWNLESKTCIQEFTAHRKKFEESIHDVAFHPSKCYIASAGADALAKVFV

SEQ ID NO: 3281 - protein, 236 aa, Homo sapiens
MAPDPWFSTYDSTCQIAQEIAEKIQQRNQYERKGEKAPKLTVTIRALLQNLKEKIALLKDLLLRAVSTHQITQLEGDRRQNLLDDLVTRERLLLASFKNEGAEPDLIRSSLMSEEAKRGAPNPWLFEEPEETRGLGFDEIRQQQQKIIQEQDAGLDALSSIISRQKQMGQEIGNELDEQNEIIDDLANLVENTDEKLRNETRRVNMVDRKSASCGMIMVILLLLVAIVVVAVWPTN

SEQ ID NO: 3282 - protein, 374 aa, Homo sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 3283 - protein, 422 aa, Homo sapiens
MVSESHHEALAAPPVTTVATVLPSNATEPASPGEGKEDAFSKLKEKFMNELHKIPLPPWALIAIAIVAVLLVLTCCFCICKKCLFKKKNKKKGKEKGGKNAINMKDVKDLGKTMKDQALKDDDAETGLTDGEEKEEPKEEEKLGKLQYSLDYDFQNNQLLVGIIQAAELPALDMGGTSDPYVKVFLLPDKKKKFETKVHRKTLNPVFNEQFTFKVPYSELGGKTLVMAVYDFDRFSKHDIIGEFKVPMNTVDFGHVTEEWRDLQSAEKEEQEKLGDICFSLRYVPTAGKLTVVILEAKNLKKMDVGGLSDPYVKIHLMQNGKRLKKKKTTIKKNTLNPYYNESFSFEVPFEQIQKVQVVVTVLDYDKIGKNDAIGKVFVGYNSTGAELRHWSDMLANPRRPIAQWHTLQVEEEVDAMLAVKK

SEQ ID NO: 3284 - protein, 1900 aa, Homo sapiens
MTRLGFLLGEKVTEVQPGDQYSMEVQDENQTSAITQRISPCSTLTSSTASPPASSPCSTLPPISTNATAKDCSYGAVTSPTSTLESRDSGIIATLTSYSENVERTKYAGESSKELGSGGNIKPWQSQKSSMDSCLYRVDENMTASTYSLNKIPERNLETVLSQSVQSIPLYLMPRPNSVAATSSAHLEDLAYLDEQRHTPLRTSLRMPRQSMGGARTQQDLRVRFAPYRPPDISLKPLLFEVPSITTESVFVGRDWVFHEIDAQLQSSNASVNQGVVIVGNIGFGKTAIISRLVALSCHGTRMRQIASDSPHASPKHVDANRELPLTQPPSAHSSITSGSCPGTPEMRRRQEEAMRRLASQVVAYHYCQADNAYTCLVPEFVHNVAALLCRSPQLTAYREQLLREPHLQSMLSLRSCVQDPMASFRRGVLEPLENLHKERKIPDEDFIILIDGLNEAEFHKPDYGDTIVSFLSKMIGKFPSWLKLIVTVRTSLQEITKLLPFHRIFLDRLEENEAIDQDLQAYILHRIHSSSEIQNNISLNGKMDNTTFGKLSSHLKTLSQGSYLYLKLTFDLIEKGYLVLKSSSYKVVPVSLSEVYLLQCNMKFPTQSSFDRVMPLLNVAVASLHPLTDEHIFQAINAGSIEGTLEWEDFQQRMENLSMFLIKRRDMTRMFVHPSFREWLIWREEGEKTKFLCDPRSGHTLLAFWFSRQEGKLNRQQTIELGHHILKAHIFKGLSKKVGVSSSILQGLWISYSTEGLSMALASLRNLYTPNIKVSRLLILGGANINYRTEVLNNAPILCVQSHLGYTEMVALLLEFGANVDASSESGLTPLGYAAAAGYLSIVVLLCKKRAKVDHLDKNGQCALVHAALRGHLEVVKFLIQCDWTMAGQQQGVFKKSHAIQQALIAAASMGYTEIVSYLLDLPEKDEEEVERAQINSFDSLWGETALTAAAGRGKLEVCRLLLEQGAAVAQPNRRGAVPLFSTVRQGHWQIVDLLLTHGADVNMADKQGRTPLMMAASEGHLGTVDFLLAQGASIALMDKEGLTALSWACLKGHLSVVRSLVDNGAATDHADKNGRTPLDLAAFYGDAEVVQFLVDHGAMIEHVDYSGMRPLDRAVGCRNTSVVVTLLKKGAKIGPATWAMATSKPDIMIILLSKLMEEGDMFYKKGKVKEAAQRYQYALKKFPREGFGEDLKTFRELKVSLLLNLSRCRRKMNDFGMAEEFATKALELKPKSYEAYYARARAKRSSRQFAAALEDLNEAIKLCPNNREIQRLLLRVEEECRQMQQPQQPPPPPQPQQQLPEEAEPEPQHEDIYSVQDIFEEEYLEQDVENVSIGLQTEARPSQGLPVIQSPPSSPPHRDSAYISSSPLGSHQVFDFRSSSSVGSPTRQTYQSTSPALSPTHQNSHYRPSPPHTSPAHQGGSYRFSPPPVGGQGKEYPSPPPSPLRRGPQYRASPPAESMSVYRSQSGSPVRYQQETSVSQLPGRPKSPLSKMAQRPYQMPQLPVAVPQQGLRLQPAKAQIVRSNQPSPAVHSSTVIPTGAYGQVAHSMASKYQSSQGDIGVSQSRLVYQGSIGGIVGDGRPVQHVQASLSAGAICQHGGLTKEDLPQRPSSAYRGGVRYSQTPQIGRSQSASYYPVCHSKLDLERSSSQLGSPDVSHLIRRPISVNPNEIKPHPPTPRPLLHSQSVGLRFSPSSNSISSTSNLTPTFRPSSSIQQMEIPLKPAYERSCDELSPVSPTQGGYPSEPTRSRTTPFMGIIDKTARTQQYPHLHQQNRTWAVSSVDTVLSPTSPGNLPQPESFSPPSSISNIAFYNKTNNAQNGHLLEDDYYSPHGMLANGSRGDLLERVSQASSYPDVKVARTLPVAQAYQDNLYRQLSRDSRQGQTSPIKPKRPFVESNV

SEQ ID NO: 3285 - protein, 1900 aa, Homo sapiens; identical to SEQ ID NO: 3284

SEQ ID NO: 3286 - protein, 274 aa, Homo sapiens
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQKQKLVKQLPLTSICLETDSPALGPEKQVRNEPWNISISAEYIAQVKGISVEEVIEVTTQNALKLFPKLRHLLQK

SEQ ID NO: 3287 - protein, 191 aa, Homo sapiens
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQAETCETIAFNFYMLRNRFTCTRTRKTGTE

SEQ ID NO: 3288 - protein, 281 aa, Homo sapiens
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQLLSLFSKKQKLVKQLPLTSICLETDSPALGPEKQVRNEPWNISISAEYIAQVKGISVEEVIEVTTQNALKLFPKLRHLLQK

SEQ ID NO: 3289 - protein, 274 aa, Homo sapiens; identical to SEQ ID NO: 3286

SEQ ID NO: 3290 - protein, 191 aa, Homo sapiens; identical to SEQ ID NO: 3287

SEQ ID NO: 3291 - protein, 281 aa, Homo sapiens; identical to SEQ ID NO: 3288

SEQ ID NO: 3292 - protein, 557 aa, Homo sapiens
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFNQTVQSSGNMTDKSSQDQLLFLFPEFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGVRYSQQGNNEITSSSTISHHGNSAMVTSQSVLQQVSPASLDPGHNLLSPDGKMISVSGGGLPPVSTLTNIHSLSHHNPQQSQNLIMTPLSGVMAIAQSLNTSQAQSVPVINSVAGSLAALQPVQFSQQLHSPHQQPLMQQSPGSHMAQQPFMAAVTQLQNSHMYAHKQEPPQYSHTSRFPSAMVVTDTSSISTLTNMSSSKQCPLQAW

SEQ ID NO: 3293 - protein, 399 aa, Homo sapiens
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFNQTVQSSGNMTDKSSQDQLLFLFPEFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGKQRLGLTASATQPSWFLPRILSGLRVFRGANAFEMILGPLSHCQNILPWK

SEQ ID NO: 3294 - protein, 1960 aa, Homo sapiens [sequence omitted]

SEQ ID NO: 3295 - protein, 1938 aa, Homo sapiens
MQSFREQSSYHGNQQSYPQEVHGSSRLEEFSPRQAQMFQNFGGTGGSSGSSGSGSGGGRRGAAAAAAAMASETSGHQGYQGFRKEAGDFYYMAGNKDPVTTGTPQPPQRRPSGPVQSYGPPQGSSFGNQYGSEGHVGQFQAQHSGLGGVSHYQQDYTGPFSPGSAQYQQQASSQQQQQQVQQLRQQLYQSHQPLPQATGQPASSSSHLQPMQRPSTLPSSAAGYQLRVGQFGQHYQSSASSSSSSSFPSPQRFSQSGQSYDGSYNVNAGSQYEGHNVGSNAQAYGTQSNYSYQPQSMKNFEQAKIPQGTQQGQQQQQPQQQQHPSQHVMQYTNAATKLPLQSQVGQYNQPEVPVRSPMQFHQNFSPISNPSPAASVVQSPSCSSTPSPLMQTGENLQCGQGSVPMGSRNRILQLMPQLSPTPSMMPSPNSHAAGFKGFGLEGVPEKRLTDPGLSSLSALSTQVANLPNTVQHMLLSDALTPQKKTSKRPSSSKKADSCTNSEGSSQPEEQLKSPMAESLDGGCSSSSEDQGERVRQLSGQSTSSDTTYKGGASEKAGSSPAQGAQNEPPRLNASPAAREEATSPGAKDMPLSSDGNPKVNEKTVGVIVSREAMTGRVEKPGGQDKGSQEDDPAATQRPPSNGGAKETSHASLPQPEPPGGGGSKGNKNGDNNSNHNGEGNGQSGHSAAGPGFTSRTEPSKSPGSLRYSYKDSFGSAVPRNVSGFPQYPTGQEKGDFTGHGERKGRNEKFPSLLQEVLQGYHHHPDRRYSRSTQEHQGMAGSLEGTTRPNVLVSQTNELASRGLLNKSIGSLLENPHWGPWERKSSSTAPEMKQINLTDYPIPRKFEIEPQSSAHEPGGSLSERRSVICDISPLRQIVRDPGAHSLGHMSADTRIGRNDRLNPTLSQSVILPGGLVSMETKLKSQSGQIKEEDFEQSKSQASFNNKKSGDHCHPPSIKHESYRGNASPGAATHDSLSDYGPQDSRPTPMRRVPGRVGGREGMRGRSPSQYHDFAEKLKMSPGRSRGPGGDPHHMNPHMTFSERANRSSLHTPFSPNSETLASAYHANTRAHAYGDPNAGLNSQLHYKRQMYQQQPEEYKDWSSGSAQGVIAAAQHRQEGPRKSPRQQQFLDRVRSPLKNDKDGMMYGPPVGTYHDPSAQEAGRCLMSSDGLPNKGMELKHGSQKLQESCWDLSRQTSPAKSSGPPGMSSQKRYGPPHETDGHGLAEATQSSKPGSVMLRLPGQEDHSSQNPLIMRRRVRSFISPIPSKRQSQDVKNSSTEDKGRLLHSSKEGADKAFNSYAHLSHSQDIKSIPKRDSSKDLPSPDSRNCPAVTLTSPAKTKILPPRKGRGLKLEAIVQKITSPNIRRSASSNSAEAGGDTVTLDDILSLKSGPPEGGSVAVQDADIEKRKGEVASDLVSPANQELHVEKPLPRSSEEWRGSVDDKVKTETHAETVTAGKEPPGAMTSTTSQKPGSNQGRPDGSLGGTAPLIFPDSKNVPPVGILAPEANPKAEEKENDTVTISPKQEGFPPKGYFPSGKKKGRPIGSVNKQKKQQQPPPPPPQPPQIPEGSADGEPKPKKQRQRRERRKPGAQPRKRKTKQAVPIVEPQEPEIKLKYATQPLDKTDAKNKSFYPYIHVVNKCELGAVCTIINAEEEEQTKLVRGRKGQRSLTPPPSSTESKALPASSFMLQGPVVTESSVMGHLVCCLCGKWASYRNMGDLFGPFYPQDYAATLPKNPPPKRATEMQSKVKVRHKSASNGSKTDTEEEEEQQQQQKEQRSLAAHPRFKRRHRSEDCGGGPRSLSRGLPCKKAATEGSSEKTVLDSKPSVPTTSEGGPELELQIPELPLDSNEFWVHEGCILWANGIYLVCGRLYGLQEALEIAREMKCSHCQEAGATLGCYNKGCSFRYHYPCAIDADCLLHEENFSVRCPKHKVRLWR

SEQ ID NO: 3296 - protein, 2542 aa, Homo sapiens
MVALSLKICVRHCNVVKTMQFEPSTAVYDACRVIRERVPEAQTGQASDYGLFLSDEDPRKGIWLEAGRTLDYYMLRNGDILEYKKKQRPQKIRMLDGSVKTVMVDDSKTVGELLVTICSRIGITNYEEYSLIQETIEEKKEEGTGTLKKDRTLLRDERKMEKLKAKLHTDDDLNWLDHSRTFREQGVDENETLLLRRKFFYSDQNVDSRDPVQLNLLYVQARDDILNGSHPVSFEKACEFGGFQAQIQFGPHVEHKHKPGFLDLKEFLPKEYIKQRGAEKRIFQAHKNCGEMSEIEAKVKYVKLARSLRTYGVSFFLVKEKMKGKNKLVPRLLGITKDSVMRVDEKTKEVLQEWPLTTVKRWAASPKSFTLDFGEYQESYYSVQTTEGEQISQLIAGYIDIILKKKQSKDRFGLEGDEESTMLEESVSPKKSTILQQQFNRTGKAEHGSVALPAVMRSGSSGPETFNVGSMPSPQQQVMVGQMHRGHMPPLTSAQQALMGTINTSMHAVQQAQDDLSELDSLPPLGQDMASRVWVQNKVDESKHEIHSQVDAITAGTASVVNLTAGDPADTDYTAVGCAITTISSNLTEMSKGVKLLAALMDDEVGSGEDLLRAARTLAGAVSDLLKAVQPTSGEPRQTVLTAAGSIGQASGDLLRQIGENETDERFQDVLMSLAKAVANAAAMLVLKAKNVAQVAEDTVLQNRVIAAATQCALSTSQLVACAKVVSPTISSPVCQEQLIEAGKLVDRSVENCVRACQAATTDSELLKQVSAAASVVSQALHDLLQHVRQFASRGEPIGRYDQATDTIMCVTESIFSSMGDAGEMVRQARVLAQATSDLVNAMRSDAEAEIDMENSKKLLAAAKLLADSTARMVEAAKGAAANPENEDQQQRLREAAEGLRVATNAAAQNAIKKKIVNRLEVAAKQAAAAATQTIAASQNAAVSNKNPAAQQQLVQSCKAVADHIPQLVQGVRGSQAQAEDLSAQLALIISSQNFLQPGSKMVSSAKAAVPTVSDQAAAMQLSQCAKNLATSLAELRTASQKAHEACGPMEIDSALNTVQTLKNELQDAKMAAVESQLKPLPGETLEKCAQDLGSTSKAVGSSMAQLLTCAAQGNEHYTGVAARETAQALKTLAQAARGVAASTTDPAAAHAMLDSARDVMEGSAMLIQEAKQALIAPGDAERQQRLAQVAKAVSHSLNNCVNCLPGQKDVDVALKSIGESSKKLLVDSLPPSTKPFQEAQSELNQAAADLNQSAGEVVHATRGQSGELAAASGKFSDDFDEFLDAGIEMAGQAQTKEDQIQVIGNLKNISMASSKLLLAAKSLSVDPGAPNAKNLLAAAARAVTESINQLITLCTQQAPGQKECDNALRELETVKGMLDNPNEPVSDLSYFDCIESVMENSKVLGESMAGISQNAKTGDLPAFGECVGIASKALCGLTEAAAQAAYLVGISDPNSQAGHQGLVDPIQFARANQAIQMACQNLVDPGSSPSQVLSAATIVAKHTSALCNACRIASSKTANPVAKRHFVQSAKEVANSTANLVKTIKALDGDFSEDNRNKCRIATAPLIEAVENLTAFASNPEFVSIPAQISSEGSQAQEPILVSAKTMLESSSYLIRTARSLAINPKDPPTWSVLAGHSHTVSDSIKSLITSIRDKAPGQRECDYSIDGINRCIRDIEQASLAAVSQSLATRDDISVEALQEQLTSVVQEIGHLIDPIATAARGEAAQLGHKVTQLASYFEPLILAAVGVASKILDHQQQMTVLDQTKTLAESALQMLYAAKEGGGNPKAQHTHDAITEAAQLMKEAVDDIMVTLNEAASEVGLVGGMVDAIAEAMSKLDEGTPPEPKGTFVDYQTTVVKYSKAIAVTAQEMMTKSVTNPEELGGLASQMTSDYGHLAFQGQMAAATAEPEEIGFQIRTRVQDLGHGCIFLVQKAGALQVCPTDSYTKRELIECARAVTEKVSLVLSALQAGNKGTQACITAATAVSGIIADLDTTIMFATAGTLNAENSETFADHRENILKTAKALVEDTKLLVSGAASTPDKLAQAAQSSAATITQLAEVVKLGAASLGSDDPETQVVLINAIKDVAKALSDLISATKGAASKPVDDPSMYQLKGAAKVMVTNVTSLLKTVKAVEDEATRGTRALEATIECIKQELTVFQSKDVPEKTSSPEESIRMTKGITMATAKAVAAGNSCRQEDVIATANLSRKAVSDMLTACKQASFHPDVSDEVRTRALRFGTECTLGYLDLLEHVLVILQKPTPEFKQQLAAFSKRVAGAVTELIQAAEAMKGTEWVDPEDPTVIAETELLGAAASIEAAAKKLEQLKPRAKPKQADETLDFEEQILEAAKSIAAATSALVKSASAAQRELVAQGKVGSIPANAADDGQWSQGLISAARMVAAATSSLCEAANASVQGHASEEKLISSAKQVAASTAQLLVACKVKADQDSEAMRRLQAAGNAVKRASDNLVRAAQKAAFGKADDDDVVVKTKFVGGIAQIIAAQEEMLKKERELEEARKKLAQIRQQQYKFLPTELREDEG

SEQ ID NO: 3297 - protein, 423 aa, Homo sapiens
MAQAVWSRLGRILWLACLLPWAPAGVAAGLYELNLTTDSPATTGAVVTISASLVAKDNGSLALPADAHLYRFHWIHTPLVLTGKMEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVENPEPPSGVRCCCQMCCGPFLLETPSEYLEIVRENHGLLPPLYKSVKTYTV

SEQ ID NO: 3298 - protein, 392 aa, Homo sapiens
MLLGAEAVGLVKECNDNTMRAFTYRTRQNFKGFDDNNDDFLTMAECQFIIKHELENLRAKDEKMIPGYPQAKLYPGKSLLRRLLTSGIVIQVFPLHDSEALKKLEDTWYTRFALKYQPIENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFEMMSVISVVTNCALIGMSPQVNAAFPESKADLILIVVAVEHALLALKFILAFAIPDKPRHIQMKLARLEFESLEALKQQQMKLVTENLKEEPMESGKEKAT

SEQ ID NO: 3299 - protein, 1383 aa, Homo sapiens
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEGVSLSGFRVEVVDGVKLNLLDDVSSWKPGDQIVVASTDYSMYQAEEFTLLPCSECSHFQVKVKETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 3300 - protein, 167 aa, Homo sapiens
MASPRTVTIVALSVALGLFFVFMGTIKLTPRLSKDAYSEMKRAYKSYVRALPLLKKMGINSILLRKSIGALEVACGIVMTLVPGRPKDVANFFLLLLVLAVLFFHQLVGDPLKRYAHALVFGILLTCRLLIARKPEDRSSEKKPLPGNAEEQPSLYEKAPQGKVKVS

SEQ ID NO: 3301 - protein, 400 aa, Homo sapiens
MAANYSSTSTRREHVKVKTSSQPGFLERLSETSGGMFVGLMAFLLSFYLIFTNEGRALKTATSLAEGLSLVVSPDSIHSVAPENEGRLVHIIGALRTSKLLSDPNYGVHLPAVKLRRHVEMYQWVETEESREYTEDGQVKKETRYSYNTEWRSEIINSKNFDREIGHKNPSAMAVESFMATAPFVQIGRFFLSSGLIDKVDNFKSLSLSKLEDPHVDIIRRGDFFYHSENPKYPEVGDLRVSFSYAGLSGDDPDLGPAHVVTVIARQRGDQLVPFSTKSGDTLLLLHHGDFSAEEVFHRELRSNSMKTWGLRAAGWMAMFMGLNLMTRILYTLVDWFPVFRDLVNIGLKAFAFCVATSLTLLTVAAGWLFYRPLWALLIAGLALVPILVARTRVPAKKLE

SEQ ID NO: 3302 - protein, 1166 aa, Homo sapiens
MSGRRCAGGGAACASAAAEAVEPAARELFEACRNGDVERVKRLVTPEKVNSRDTAGRKSTPLHFAAGFGRKDVVEYLLQNGANVQARDDGGLIPLHNACSFGHAEVVNLLLRHGADPNARDNWNYTPLHEAAIKGKIDVCIVLLQHGAEPTIRNTDGRTALDLADPSAKAVLTGEYKKDELLESARSGNEEKMMALLTPLNVNCHASDGRKSTPLHLAAGYNRVKIVQLLLQHGADVHAKDKGDLVPLHNACSYGHYEVTELLVKHGACVNAMDLWQFTPLHEAASKNRVEVCSLLLSYGADPTLLNCHNKSAIDLAPTPQLKERLAYEFKGHSLLQAAREADVTRIKKHLSLEMVNFKHPQTHETALHCAAASPYPKRKQICELLLRKGANINEKTKEFLTPLHVASEKAHNDVVEVVVKHEAKVNALDNLGQTSLHRAAYCGHLQTCRLLLSYGCDPNIISLQGFTALQMGNENVQQLLQEGISLGNSEADRQLLEAAKAGDVETVKKLCTVQSVNCRDIEGRQSTPLHFAAGYNRVSVVEYLLQHGADVHAKDKGGLVPLHNACSYGHYEVAELLVKHGAVVNVADLWKFTPLHEAAAKGKYEICKLLLQHGADPTKKNRDGNTPLDLVKDGDTDIQDLLRGDAALLDAAKKGCLARVKKLSSPDNVNCRDTQGRHSTPLHLAAGYNNLEVAEYLLQHGADVNAQDKGGLIPLHNAASYGHVDVAALLIKYNACVNATDKWAFTPLHEAAQKGRTQLCALLLAHGADPTLKNQEGQTPLDLVSADDVSALLTAAMPPSALPSCYKPQVLNGVRSPGATADALSSGPSSPSSLSAASSLDNLSGSFSELSSVVSSSGTEGASSLEKKEVPGVDFSITQFVRNLGLEHLMDIFEREQITLDVLVEMGHKELKEIGINAYGHRHKLIKGVERLISGQQGLNPYLTLNTSGSGTILIDLSPDDKEFQSVEEEMQSTVREHRDGGHAGGIFNRYNILKIQKVCNKKLWERYTHRRKEVSEENHNHANERMLFHGSPFVNAIIHKGFDERHAYIGGMFGAGIYFAENSSKSNQYVYGIGGGTGCPVHKDRSCYICHRQLLFCRVTLGKSFLQFSAMKMAHSPPGHHSVTGRPSVNGLALAEYVIYRGEQAYPEYLITYQIMRPEGMVDG

SEQ ID NO: 3303 - protein, 175 aa, Homo sapiens
MLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRNSPTFKSFEERVETTVTSLKTKVGGTNPNGGSFEEVLSSTAHASAQSLAGGSRRTKEEELQC

SEQ ID NO: 3304 - protein, 144 aa, Homo sapiens
MEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRRK

SEQ ID NO: 3305 - protein, 131 aa, Homo sapiens
MEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMRRK

SEQ ID NO: 3306 - protein, 204 aa, Homo sapiens
MEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRNSPTFKSFEERVETTVTSLKTKVGGTNPNGGSFEEVLSSTAHASAQSLAGGSRRTKEEELQC

SEQ ID NO: 3307 - protein, 710 aa, Homo sapiens
MEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKSQLSQALNGLSDRAKEAKEFLVQLRNMVQQIQENSVEFEACLVAQCDALIDALNRRKAQLLARVNKEHEHKLKVVRDQISHCTVKLRQTTGLMEYCLEVIKENDPSGFLQISDALIRRVHLTEDQWGKGTLTPRMTTDFDLSLDNSPLLQSIHQLDFVQVKASSPVPATPILQLEECCTHNNSATLSWKQPPLSTVPADGYILELDDGNGGQFREVYVGKETMCTVDGLHFNSTYNARVKAFNKTGVSPYSKTLVLQTSEVAWFAFDPGSAHSDIILSNDNLTVTCSSYDDRVVLGKTGFSKGIHYWELTVDRYDNHPDPAFGVARMDVMKDVMLGKDDKAWAMYVDNNRSWFMHNNSHTNRTEGGITKGATIGVLLDFNRKNLTFFINDEQQGPIAFDNVEGLFFPAVSLNRNVQVTLHTGLPVPDFYSSRASIA

SEQ ID NO: 3308 - protein, 26926 aa, Homo sapiens
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDLRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENITSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEAPESILHERIEQEIEMEMKEFSSSFLSAEEEGLHSAELQLSKINETLELLSESPVYSTKFDSEKEGTGPIFIKEVSNADISMGDVATLSVTVIGIPKPKIQWFFNGVLLTPSADYKFVFDGDDHSLIILFTKLEDEGEYTCMASNDYGKTICSAYLKINSKGEGHKDTETESAVAKSLEKLGGPCPPHFLKELKPIRCAQGLPAIFEYTVVGEPAPTVTWFKENKQLCTSVYYTIIHNPNGSGTFIVNDPQREDSGLYICKAENMLGESTCAAELLVLLEDTDMTDTPCKAKSTPEAPEDFPQTPLKGPAVEALDSEQEIATFVKDTILKAALITEENQQLSYEHIAKANELSSQLPLGAQELQSILEQDKLTPESTREFLCINGSIHFQPLKEPSPNLQLQIVQSQKTFSKEGILMPEEPETQAVLSDTEKIFPSAMSIEQINSLTVEPLKTLLAEPEGNYPQSSIEPPMHSYLTSVAEEVLSPKEKTVSDTNREQRVTLQKQEAQSALILSQSLAEGHVESLQSPDVMISQVNYEPLVPSEHSCTEGGKILIESANPLENAGQDSAVRIEEGKSLRFPLALEEKQVLLKEEHSDNVVMPPDQIIESKREPVAIKKVQEVQGRDLLSKESLLSGIPEEQRLNLKIQICRALQAAVASEQPGLFSEWLRNIEKVEVEAVNITQEPRHIMCMYLVTSAKSVTEEVTIIIEDVDPQMANLKMELRDALCAIIYEEIDILTAEGPRIQQGAKTSLQEEMDSFSGSQKVEPITEPEVESKYLISTEEVSYFNVQSRVKYLDATPVTKGVASAVVSDEKQDESLKPSEEKEESSSESGTEEVATVKIQEAEGGLIKEDGPMIHTPLVDTVSEEGDIVHLTTSITNAKEVNWYFENKLVPSDEKFKCLQDQNTYTLVIDKVNTEDHQGEYVCEALNDSGKTATSAKLTVVKRAAPVIKRKIEPLEVALGHLAKFTCEIQSAPNVRFQWFKAGREIYESDKCSIRSSKYISSLEILRTQVVDCGEYTCKASNEYGSVSCTATLTVTVPGGEKKVRKLLPERKPEPKEEVVLKSVLRKRPEEEEPKVEPKKLEKVKKPAVPEPPPPKPVEEVEVPTVTKRERKIPEPTKVPEIKPAIPLPAPEPKPKPEAEVKTIKPPPVEPEPTPIAAPVTVPVVGKKAEAKAPKEEAAKPKGPIKGVPKKTPSPIEAERRKLRPGSGGEKPPDEAPFTYQLKAVPLKFVKEIKDIILTESEFVGSSAIFECLVSPSTAITTWMKDGSNIRESPKHRFIADGKDRKLHIIDVQLSDAGEYTCVLRLGNKEKTSTAKLVVEELPVRFVKTLEEEVTVVKGQPLYLSCELNKERDVVWRKDGKIVVEKPGRIVPGVIGLMRALTINDADDTDAGTYTVTVENANNLECSSCVKVVEVIRDWLVKPIRDQHVKPKGTAIFACDIAKDTPNIKWFKGYDEIPAEPNDKTEILRDGNHLYLKIKNAMPEDIAEYAVEIEGKRYPAKLTLGEREVELLKPIEDVTIYEKESASFDAEISEADIPGQWKLKGELLRPSPTCEIKAEGGKRFLTLHKVKLDQAGEVLYQALNAITTAILTVKEIELDFAVPLKDVTVPERRQARFECVLTREANVIWSKGPDIIKSSDKFDIIADGKKHILVINDSQFDDEGVYTAEVEGKKTSARLFVTGIRLKFMSPLEDQTVKEGETATFVCELSHEKMHVVWFKNDAKLHTSRTVLISSEGKTHKLEMKEVTLDDISQIKAQVKELSSTAQLKVLEADPYFTVKLHDKTAVEKDEITLKCEVSKDVPVKWFKDGEEIVPSPKYSIKADGLRRILKIKKADLKDKGEYVCDCGTDKTKANVTVEARLIKVEKPLYGVEVFVGETAHFEIELSEPDVHGQWKLKGQPLTASPDCEIIEDGKKHILILHNCQLGMTGEVSFQAANAKSAANLKVKELPLIFITPLSDVKVFEKDEAKFECEVSREPKTFRWLKGTQEITGDDRFELIKDGTKHSMVIKSAAFEDEAKYMFEAEDKHTSGKLIIEGIRLKFLTPLKDVTAKEKESAVFTVELSHDNIRVKWFKNDQRLHTTRSVSMQDEGKTHSITFKDLSIDDTSQIRVEAMGMSSEAKLTVLEGDPYFTGKLQDYTGVEKDEVILQCEISKADAPVKWFKDGKEIKPSKNAVIKADGKKRMLILKKALKSDIGQYTCDCGTDKTSGKLDIEDREIKLVRPLHSVEVMETETARFETEISEDDIHANWKLKGEALLQTPDCEIKEEGKIHSLVLHNCRLDQTGGVDFQAANVKSSAHLRVKPRVIGLLRPLKDVTVTAGETATFDCELSYEDIPVEWYLKGKKLEPSDKVVPRSEGKVHTLTLRDVKLEDAGEVQLTAKDFKTHANLFVKEPPVEFTKPLEDQTVEEGATAVLECEVSRENAKVKWFKNGTEILKSKKYEIVADGRVRKLVIHDCTPEDIKTYTCDAKDFKTSCNLNVVPPHVEFLRPLTDLQVREKEMARFECELSRENAKVKWFKDGAEIKKGKKYDIISKGAVRILVINKCLLDDEAEYSCEVRTARTSGMLTVLEEEAVFTKNLANIEVSETDTIKLVCEVSKPGAEVIWYKGDEEIIETGRYEILTEGRKRILVIQNAHLEDAGNYNCRLPSSRTDGKVKVHELAAEFISKPQNLEILEGEKAEFVCSISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPLKDIETMEKKSVTFWCKVNRLNVTLKWTKNGEEVPFDNRVSYRVDKYKHMLTIKDCGFPDEGEYIVTAGQDKSVAELLIIEAPTEFVEHLEDQTVTEFDDAVFSCQLSREKANVKWYRNGREIKEGKKYKFEKDGSIHRLIIKDCRLDDECEYACGVEDRKSRARLFVEEIPVEIIRPPQDILEAPGADVVFLAELNKDKVEVQWLRNNMVVVQGDKHQMMSEGKIHRLQICDIKPRDQGEYRFIAKDKEARAKLELAAAPKIKTADQDLVVDVGKPLTMVVPYDAYPKAEAEWFKENEPLSTKTIDTTAEQTSFRILEAKKGDKGRYKIVLQNKHGKAEGFINLKVIDVPGPVRNLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFVEPTMDLSAFKDGLEVIVPNPITILVPSTGYPRPTATWCFGDKVLETGDRVKMKTLSAYAELVISPSERSDKGIYTLKLENRVKTISGEIDVNVIARPSAPKELKFGDITKDSVHLTWEPPDDDGGSPLTGYVVEKREVSRKTWTKVMDFVTDLEFTVPDLVQGKEYLFKVCARNKCGPGEPAYVDEPVNMSTPATVPDPPENVKWRDRTANSIFLTWDPPKNDGGSRIKGYIVERCPRGSDKWVACGEPVAETKMEVTGLEEGKWYAYRVKALNRQGASKPSRPTEEIQAVDTQEAPEIFLDVKLLAGLTVKAGTKIELPATVTGKPEPKITWTKADMILKQDKRITIENVPKKSTVTIVDSKRSDTGTYIIEAVNVCGRATAVVEVNVLDKPGPPAAFDITDVTNESCLLTWNPPRDDGGSKITNYVVERRATDSEVWHKLSSTVKDTNFKATKLIPNKEYIFRVAAENMYGVGEPVQASPITAKYQFDPPGPPTRLEPSDITKDAVTLTWCEPDDDGGSPITGYWVERLDPDTDKWVRCNKMPVKDTTYRVKGLTNKKKYRFRVLAENLAGPGKPSKSTEPILIKDPIDPPWPPGKPTVKDVGKTSVRLNWTKPEHDGGAKIESYVIEMLKTGTDEWVRVAEGVPTTQHLLPGLMEGQEYSFRVRAVNKAGESEPSEPSDPVLCREKLYPPSPPRWLEVINITKNTADLKWTVPEKDGGSPITNYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWVKAGKTAGPDCNFRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKPTIDLETHDIIVIEGEKLSIPVPFRAVPVPTVSWHKDGKEVKASDRLTMKNDHISAHLEVPKSVRADAGIYTITLENKLGSATASINVKVIGLPGPCKDIKASDITKSSCKLTWEPPEFDGGTPILHYVLERREAGRRTYIPVMSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRATPPTKAVDPIDAPKVILRTSLEVKRGDEIALDASISGSPYPTITWIKDENVIVPEEIKKRAAPLVRRRKGEVQEEEPFVLPLTQRLSIDNSKKGESQLRVRDSLRPDHGLYMIKVENDHGIAKAPCTVSVLDTPGPPINFVFEDIRKTSVLCKWEPPLDDGGSEIINYTLEKKDKTKPDSEWIVVTSTLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPISPPGPPIPRVTDTSSTTIELEWEPPAFNGGGEIVGYFVDKQLVGTNEWSRCTEKMIKVRQYTVKEIREGADYKLRVSAVNAAGEGPPGETQPVTVAEPQEPPAVELDVSVKGGIQIMAGKTLRIPAVVTGRPVPTKVWTKEEGELDKDRVVIDNVGTKSELIIKDALRKDHGRYVITATNSCGSKFAAARVEVFDVPGPVLDLKPVVTNRKMCLLNWSDPEDDGGSEITGFIIERKDAKMHTWRQPIETERSKCDITGLLEGQEYKFRVIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKGTYTVTASNRLGSVFRNVHVEVYDRPSPPRNLAVTDIKAESCYLTWDAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKIGLITKNTVHLSWKPPKNDGGSPVTHYIVECLAWDPTGTKKEAWRQCNKRDVEELQFTVEDLVEGGEYEFRVKAVNAAGVSKPSATVGPCDCQRPDMPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFRVSAVNIAGIGEPGEVTDVIEMKDRLVSPDLQLDASVRDRIVVHAGGVIRIIAYVSGKPPPTVTWNMNERTLPQEATIETTAISSSMVIKNCQRSHQGVYSLLAKNEAGERKKTIIVDVLDVPGPVGTPFLAHNLTNESCKLTWFSPEDDGGSPITNYVIEKRESDRRAWTPVTYTVTRQNATVQGLIQGKAYFFRIAAENSIGMGPFVETSEALVIREPITVPERPEDLEVKEVTKNTVTLTWNPPKYDGGSEIINYVLESRLIGTEKFHKVTNDNLLSRKYTVKGLKEGDTYEYRVSAVNIVGQGKPSFCTKPITCKDELAPPTLHLDFRDKLTIRVGEAFALTGRYSGKPKPKVSWFKDEADVLEDDRTHIKTTPATLALEKIKAKRSDSGKYCVVVENSTGSRKGFCQVNVVDRPGPPVGPVSFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFPKVTWKKEDRDAPTKARIDVTPVGSKLEIRNAAHEDGGIYSLTVENPAGSKTVSVKVLVLDKPGPPRDLEVSEIRKDSCYLTWKEPLDDGGSVITNYVVERRDVASAQWSPLSATSKKKSHFAKHLNEGNQYLFRVAAENQYGRGPFVETPKPIKALDPLHPPGPPKDLHHVDVDKTEVSLVWNKPDRDGGSPITGYLVEYQEEGTQDWIKFKTVTNLECVVTGLQQGKTYRFRVKAENIVGLGLPDTTIPIECQEKLVPPSVELDVKLIEGLVVKAGTTVRFPAIIRGVPVPTAKWTTDGSEIKTDEHYTVETDNFSSVLTIKNCLRRDTGEYQITVSNAAGSKTVAVHLTVLDVPGPPTGPINILDVTPEHMTISWQPPKDDGGSPVINYIVEKQDTRKDTWGVVSSGSSKTKLKIPHLQKGCEYVFRVRAENKIGVGPPLDSTPTVAKHKFSPPSPPGKPVVTDITENAATVSWTLPKSDGGSPITGYYMERREVTGKWVRVNKTPIADLKFRVTGLYEGNTYEFRVFAENLAGLSKPSPSSDPIKACRPIKPPGPPINPKLKDKSRETADLVWTKPLSDGGSPILGYVVECQKPGTAQWNRINKDELIRQCAFRVPGLIEGNEYRFRIKAANIVGEGEPRELAESVIAKDILHPPEVELDVTCRDVITVRVGQTIRILARVKGRPEPDITWTKEGKVLVREKRVDLIQDLPRVELQIKEAVRADHGKYIISAKNSSGHAQGSAIVNVLDRPGPCQNLKVTNVTKENCTISWENPLDNGGSEITNFIVEYRKPNQKGWSIVASDVTKRLIKANLLANNEYYFRVCAENKVGVGPTIETKTPILAINPIDRPGEPENLHIADKGKTFVYLKWRRPDYDGGSPNLSYHVERRLKGSDDWERVHKGSIKETHYMVDRCVENQIYEFRVQTKNEGGESDWVKTEEVVVKEDLQKPVLDLKLSGVLTVKAGDTIRLEAGVRGKPFPEVAWTKDKDATDLTRSPRVKIDTRADSSKFSLTKAKRSDGGKYVVTATNTAGSFVAYATVNVLDKPGPVRNLKIVDVSSDRCTVCWDPPEDDGGCEIQNYILEKCETKRMVWSTYSATVLTPGTTVTRLIEGNEYIFRVRAENKIGTGPPTESKPVIAKTKYDKPGRPDPPEVTKVSKEEMTVVWNPPEYDGGKSITGYFLEKKEKHSTRWVPVNKSAIPERRMKVQNLLPDHEYQFRVKAENEIGIGEPSLPSRPVVAKDPIEPPGPPTNFRVVDTTKHSITLGWGKPVYDGGAPIIGYVVEMRPKIADASPDEGWKRCNAAAQLVRKEFTVTSLDENQEYEFRVCAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVNPAGEKAVFVNVRVLDTPGPVSDLKVSDVTKTSCHVSWAPPENDGGSQVTHYIVEKREADRKTWSTVTPEVKKTSFHVTNLVPGNEYYFRVTAVNEYGPGVPTDVPKPVLASDPLSEPDPPRKLEVTEMTKNSATLAWLPPLRDGGAKIDGYITSYREEEQPADRWTEYSVVKDLSLVVTGLKEGKKYKFRVAARNAVGVSLPREAEGVYEAKEQLLPPKILMPEQITIKAGKKLRIEAHVYGKPHPTCKWKKGEDEVVTSSHLAVHKADSSSILIIKDVTRKDSGYYSLTAENSSGTDTQKIKVVVMDAPGPPQPPFDISDIDADACSLSWHIPLEDGGSNITNYIVEKCDVSRGDWVTALASVTKTSCRVGKLIPGQEYIFRVRAENRFGISEPLTSPKMVAQFPFGVPSEPKNARVTKVNKDCIFVAWDRPDSDGGSPIIGYLIERKERNSLLWVKANDTLVRSTEYPCAGLVEGLEYSFRIYALNKAGSSPPSKPTEYVTARMPVDPPGKPEVIDVTKSTVSLIWARPKHDGGSKIIGYFVEACKLPGDKWVRCNTAPHQIPQEEYTATGLEEKAQYQFRAIARTAVNISPPSEPSDPVTILAENVPPRIDLSVAMKSLLTVKAGTNVCLDATVFGKPMPTVSWKKDGTLLKPAEGIKMAMQRNLCTLELFSVNRKDSGDYTITAENSSGSKSATIKLKVLDKPGPPASVKINKMYSDRAMLSWEPPLEDGGSEITNYIVDKRETSRPNWAQVSATVPITSCSVEKLIEGHEYQFRICAENKYGVGDPVFTEPAIAKNPYDPPGRCDPPVISNITKDHMTVSWKPPADDGGSPITGYLLEKRETQAVNWTKVNRKPIIERTLKATGLQEGTEYEFRVTAINKAGPGKPSDASKAAYARDPQYPPAPPAFPKVYDTTRSSVSLSWGKPAYDGGSPIIGYLVEVKRADSDNWVRCNLPQNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVLDTPGPPVNVTVKEISKDSAYVTWEPPIIDGGSPIINYVVQKRDAERKSWSTVTTECSKTSFRVANLEEGKSYFFRVFAENEYGIGDPGETRDAVKASQTPGPVVDLKVRSVSKSSCSIGWKKPHSDGGSRIIGYVVDFLTEENKWQRVMKSLSLQYSAKDLTEGKEYTFRVSAENENGEGTPSEITVVARDDVVAPDLDLKGLPDLCYLAKENSNFRLKIPIKGKPAPSVSWKKGEDPLATDTRVSVESSAVNTTLIVYDCQKSDAGKYTITLKNVAGTKEGTISIKVVGKPGIPTGPIKFDEVTAEAMTLKWAPPKDDGGSEITNYILEKRDSVNNKWVTCASAVQKTTFRVTRLHEGMEYTFRVSAENKYGVGEGLKSEPIVARHPFDVPDAPPPPNIVDVRHDSVSLTWTDPKKTGGSPITGYHLEFKERNSLLWKRANKTPIRMRDFKVTGLTEGLEYEFRVMAINLAGVGKPSLPSEPVVALDPIDPPGKPEVINITRNSVTLIWTEPKYDGGHKLTGYIVEKRDLPSKSWMKANHVNVPECAFTVTDLVEGGKYEFRIRAKNTAGAISAPSESTETIICKDEYEAPTIVLDPTIKDGLTIKAGDTIVLNAISILGKPLPKSSWSKAGKDIRPSDITQITSTPTSSMLTIKYATRKDAGEYTITATNPFGTKVEHVKVTVLDVPGPPGPVEISNVSAEKATLTWTPPLEDGGSPIKSYILEKRETSRLLWTVVSEDIQSCRHVATKLIQGNEYIFRVSAVNHYGKGEPVQSEPVKMVDRFGPPGPPEKPEVSNVTKNTATVSWKRPVDDGGSEITGYHVERREKKSLRWVRAIKTPVSDLRCKVTGLQEGSTYEFRVSAENRAGIGPPSEASDSVLMKDAAYPPGPPSNPHVTDTTKKSASLAWGKPHYDGGLEITGYVVEHQKVGDEAWIKDTTGTALRITQFVVPDLQTKEKYNFRISAINDAGVGEPAVIPDVEIVEREMAPDFELDAELRRTLVVRAGLSIRIFVPIKGRPAPEVTWTKDNINLKNRANIENTESFTLLIIPECNRYDTGKFVMTIENPAGKKSGFVNVRVLDTPGPVLNLRPTDITKDSVTLHWDLPLIDGGSRITNYIVEKREATRKSYSTATTKCHKCTYKVTGLSEGCEYFFRVMAENEYGIGEPTETTEPVKASEAPSPPDSLNIMDITKSTVSLAWPKPKHDGGSKITGYVIEAQRKGSDQWTHITTVKGLECVVRNLTEGEEYTFQVMAVNSAGRSAPRESRPVIVKEQTMLPELDLRGIYQKLVIAKAGDNIKVEIPVLGRPKPTVTWKKGDQILKQTQRVNFETTATSTILNINECVRSDSGPYPLTARNIVGEVGDVITIQVHDIPGPPTGPIKFDEVSSDFVTFSWDPPENDGGVPISNYVVEMRQTDSTTWVELATTVIRTTYKATRLTTGLEYQFRVKAQNRYGVGPGITSACIVANYPFKVPGPPGTPQVTAVTKDSMTISWHEPLSDGGSPILGYHVERKERNGILWQTVSKALVPGNIFKSSGLTDGIAYEFRVIAENMAGKSKPSKPSEPMLALDPIDPPGKPVPLNITRHTVTLKWAKPEYTGGFKITSYIVEKRDLPNGRWLKANFSNILENEFTVSGLTEDAAYEFRVIAKNAAGAISPPSEPSDAITCRDDVEAPKIKVDVKFKDTVILKAGEAFRLEADVSGRPPPTMEWSKDGKELEGTAKLEIKIADFSTNLVNKDSTRRDSGAYTLTATNPGGFAKHIFNVKVLDRPGPPEGPLAVTEVTSEKCVLSWFPPLDDGGAKIDHYIVQKRETSRLAWTNVASEVQVTKLKVTKLLKGNEYIFRVMAVNKYGVGEPLESEPVLAVNPYGPPDPPKNPEVTTITKDSMVVCWGHPDSDGGSEIINYIVERRDKAGQRWIKCNKKTLTDLRYKVSGLTEGHEYEFRIMAENAAGISAPSPTSPFYKACDTVFKPGPPGNPRVLDTSRSSISIAWNKPIYDGGSEITGYMVEIALPEEDEWQIVTPPAGLKATSYTITGLTENQEYKIRIYAMNSEGLGEPALVPGTPKAEDRMLPPEIELDADLRKVVTIRACCTLRLFVPIKGRPAPEVKWARDHGESLDKASIESTSSYTLLIVGNVNRFDSGKYILTVENSSGSKSAFVNVRVLDTPGPPQDLKVKEVTKTSVTLTWDPPLLDGGSKIKNYIVEKRESTRKAYSTVATNCHKTSWKVDQLQEGCSYYFRVLAENEYGIGLPAETAESVKASERPLPPGKITLMDVTRNSVSLSWEKPEHDGGSRILGYIVEMQTKGSDKWATCATVKVTEATITGLIQGEEYSFRVSAQNEKGISDPRQLSVPVIAKDLVIPPAFKLLFNTFTVLAGEDLKVDVPFIGRPTPAVTWHKDNVPLKQTTRVNAESTENNSLLTIKDACREDVGHYVVKLTNSAGEAIETLNVIVLDKPGPPTGPVKMDEVTADSITLSWGPPKYDGGSSINNYIVEKRDTSTTTWQIVSATVARTTIKACRLKTGCEYQFRIAAENRYGKSTYLNSEPTVAQYPFKVPGPPGTPVVTLSSRDSMEVQWNEPISDGGSRVIGYHLERKERNSILWVKLNKTPIPQTKFKTTGLEEGVEYEFRVSAENIVGIGKPSKVSECYVARDPCDPPGRPEAIIVTRNSVTLQWKKPTYDGGSKITGYIVEKKELPEGRWMKASFTNIIDTHFEVTGLVEDHRYEFRVIARNAAGVFSEPSESTGAITARDEVDPPRISMDPKYKDTIVVHAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQDGGSDIINYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSPPSAYQKACDPIYKPGPPNNPKVIDITRSSVFLSWSKPIYDGGCEIQGYIVEKCDVSVGEWTMCTPPTGINKTNIEVEKLLEKHEYNFRICAINKAGVGEHADVPGPIIVEEKLEAPDIDLDLELRKIINIRAGGSLRLFVPIKGRPTPEVKWGKVDGEIRDAAIIDVTSSFTSLVLDNVNRYDSGKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPISGRPKPTITWTKDGLPLKQTTRINVTDSLDLTTLSIKETHKDDGGQYGITVANVVGQKTASIEIVTLDKPDPPKGPVKFDDVSAESITLSWNPPLYTGGCQITNYIVQKRDTTTTVWDVVSATVARTTLKVTKLKTGTEYQFRIFAENRYGQSFALESDPIVAQYPYKEPGPPGTPFATAISKDSMVIQWHEPVNNGGSPVIGYHLERKERNSILWTKVNKTIIHDTQFKAQNLEEGIEYEFRVYAENIVGVGKASKNSECYVARDPCDPPGTPEPIMVKRNEITLQWTKPVYDGGSMITGYIVEKRDLPDGRWMKASFTNVIETQFTVSGLTEDQRYEFRVIAKNAAGAISKPSDSTGPITAKDEVELPRISMDPKFRDTIVVNAGETFRLEADVHGKPLPTIEWLRGDKEIEESARCEIKNTDFKALLIVKDAIRIDGGQYILRASNVAGSKSFPVNVKVLDRPGPPEGPVQVTGVTSEKCSLTWSPPLQDGGSDISHYVVEKRETSRLAWTVVASEVVTNSLKVTKLLEGNEYVFRIMAVNKYGVGEPLESAPVLMKNPFVLPGPPKSLEVTNIAKDSMTVCWNRPDSDGGSEIIGYIVEKRDRSGIRWIKCNKRRITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENEFGVGVPVETVDAVKAAEPPSPPGKVTLTDVSQTSASLMWEKPEHDGGSRVLGYVVEMQPKGTEKWSIVAESKVCNAVVTGLSSGQEYQFRVKAYNEKGKSDPRVLGVPVIAKDLTIQPSLKLPFNTYSIQAGEDLKIEIPVIGRPRPNISWVKDGEPLKQTTRVNVEETATSTVLHIKEGNKDDFGKYTVTATNSAGTATENLSVIVLEKPGPPVGPVRFDEVSADFVVISWEPPAYTGGCQISNYIVEKRDTTTTTWHMVSATVARTTIKITKLKTGTEYQFRIFAENRYGKSAPLDSKAVIVQYPFKEPGPPGTPFVTSISKDQMLVQWHEPVNDGGTKIIGYHLEQKEKNSILWVKLNKTPIQDTKFKTTGLDEGLEYEFKVSAENIVGIGKPSKVSECFVARDPCDPPGRPEAIVITRNNVTLKWKKPAYDGGSKITGYIVEKKDLPDGRWMKASFTNVLETEFTVSGLVEDQRYEFRVIARNAAGNFSEPSDSSGAITARDEIDAPNASLDPKYKDVIVVHAGETFVLEADIRGKPIPDVVWSKDGKELEETAARMEIKSTIQKTTLVVKDCIRTDGGQYILKLSNVGGTKSIPITVKVLDRPGPPEGPLKVTGVTAEKCYLAWNPPLQDGGANISHYIIEKRETSRLSWTQVSTEVQALNYKVTKLLPGNEYIFRVMAVNKYGIGEPLESGPVTACNPYKPPGPPSTPEVSAITKDSMVVTWARPVDDGGTEIEGYILEKRDKEGVRWTKCNKKTLTDLRLRVTGLTEGHSYEFRVAAENAAGVGEPSEPSVFYRACDALYPPGPPSNPKVTDTSRSSVSLAWSKPIYDGGAPVKGYVVEVKEAAADEWTTCTPPTGLQGKQFTVTKLKENTEYNFRICAINSEGVGEPATLPGSVVAQERIEPPEIELDADLRKVVVLRASATLRLFVTIKGRPEPEVKWEKAEGILTDRAQIEVTSSFTMLVIDNVTRFDSGRYNLTLENNSGSKTAFVNVRVLDSPSAPVNLTIREVKKDSVTLSWEPPLIDGGAKITNYIVEKRETTRKAYATITNNCTKTTFRIENLQEGCSYYFRVLASNEYGIGLPAETTEPVKVSEPPLPPGRVTLVDVTRNTATIKWEKPESDGGSKITGYVVEMQTKGSEKWSTCTQVKTLEATISGLTAGEEYVFRVAAVNEKGRSDPRQLGVPVIARDIEIKPSVELPFHTFNVKAREQLKIDVPFKGRPQATVNWRKDGQTLKETTRVNVSSSKTVTSLSIKEASKEDVGTYELCVSNSAGSITVPITIIVLDRPGPPGPIRIDEVSCDSITISWNPPEYDGGCQISNYIVEKKETTSTTWHIVSQAVARTSIKIVRLTTGSEYQFRVCAENRYGKSSYSESSAVVAEYPFSPPGPPGTPKVVHATKSTMLVTWQVPVNDGGSRVIGYHLEYKERSSILWSKANKILIADTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRYEFRVFARNAADSVSEPSESTGPIIVKDDVEPPRVMMDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNSLRWVRVNKKPVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTKESAVLSWDVPENDGGAPVKNYHIEKREASKKAWVSVTNNCNRLSYKVTNLQEGAIYYFRVSGENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSILWQKANKLVIRTTHFKVTTISAGLIYEFRVYAENAAGVGKPSHPSEPVLAIDACEPPRNVRITDISKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDARYSIENTDSSSLLTIPQVTRNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWRMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKDGGGTEITNYIVEKRESGTTAWQLVNSSVKRTQIKVTHLTKYMEYSFRVSSENRFGVSKPLESAPIIAEHPFVPPSAPTRPEVYHVSANAMSIRWEEPYHDGGSKIIGYWVEKKERNTILWVKENKVPCLECNYKVTGLVEGLEYQFRTYALNAAGVSKASEASRPIMAQNPVDAPGRPEVTDVTRSTVSLIWSAPAYDGGSKVVGYIIERKPVSEVGDGRWLKCNYTIVSDNFFTVTALSEGDTYEFRVLAKNAAGVISKGSESTGPVTCRDEYAPPKAELDARLHGDLVTIRAGSDLVLDAAVGGKPEPKIIWTKGDKELDLCEKVSLQYTGKRATAVIKFCDRSDSGKYTLTVKNASGTKAVSVMVKVLDSPGPCGKLTVSRVTQEKCTLAWSLPQEDGGAEITHYIVERRETSRLNWVIVEGECPTLSYVVTRLIKNNEYIFRVRAVNKYGPGVPVESEPIVARNSFTIPSPPGIPEEVGTGKEHIIIQWTKPESDGGNEISNYLVDKREKKSLRWTRVNKDYVVYDTRLKVTSLMEGCDYQFRVTAVNAAGNSEPSEASNFISCREPSYTPGPPSAPRVVDTTKHSISLAWTKPMYDGGTDIVGYVLEMQEKDTDQWYRVHTNATIRNTEFTVPDLKMGQKYSFRVAAVNVKGMSEYSESIAEIEPVERIEIPDLELADDLKKTVTIRAGASLRLMVSVSGRPPPVITWSKQGIDLASRAIIDTTESYSLLIVDKVNRYDAGKYTIEAENQSGKKSATVLVKVYDTPGPCPSVKVKEVSRDSVTITWEIPTIDGGAPVNNYIVEKREAAMRAFKTVTTKCSKTLYRISGLVEGTMYYFRVLPENIYGIGEPCETSDAVLVSEVPLVPAKLEVVDVTKSTVTLAWEKPLYDGGSRLTGYVLEACKAGTERWMKVVTLKPTVLEHTVTSLNEGEQYLFRIRAQNEKGVSEPRETVTAVTVQDLRVLPTIDLSTMPQKTIHVPAGRPVELVIPIAGRPPPAASWFFAGSKLRESERVTVETHTKVAKLTIRETTIRDTGEYTLELKNVTGTTSETIKVIILDKPGPPTGPIKIDEIDATSITISWEPPELDGGAPLSGYVVEQRDAHRPGWLPVSESVTRSTFKFTRLTEGNEYVFRVAATNRFGIGSYLQSEVIECRSSIRIPGPPETLQIFDVSRDGMTLTWYPPEDDGGSQVTGYIVERKEVRADRWVRVNKVPVTMTRYRSTGLTEGLEYEHRVTAINARGSGKPSRPSKPIVAMDPIAPPGKPQNPRVTDTTRTSVSLAWSVPEDEGGSKVTGYLIEMQKVDQHEWTKCNTTPTKIREYTLTHLPQGAEYRFRVLACNAGGPGEPAEVPGTVKVTEMLEYPDYELDERYQEGIFVRQGGVIRLTIPIKGKPFPICKWTKEGQDISKRAMIATSETHTELVIKEADRGDSGTYDLVLENKCGKKAVYIKVRVIGSPNSPEGPLEYDDIQVRSVRVSWRPPADDGGADILGYILERREVPKAAWYTIDSRVRGTSLVVKGLKENVEYHFRVSAENQFGISKPLKSEEPVTPKTPLNPPEPPSNPPEVLDVTKSSVSLSWSRPKDDGGSRVTGYYIERKETSTDKWVRHNKTQITTTMYTVTGLVPDAEYQFRIIAQNDVGLSETSPASEPVVCKDPFDKPSQPGELEILSISKDSVTLQWEKPECDGGKEILGYWVEYRQSGDSAWKKSNKERIKDKQFTIGGLLEATEYEFRVFAENETGLSRPRRTAMSIKTKLTSGEAPGIRKEMKDVTTKLGEAAQLSCQIVGRPLPDIKWYRFGKELIQSRKYKMSSDGRTHTLTVMTEEQEDEGVYTCIATNEVGEVETSSKLLLQATPQFHPGYPLKEKYYGAVGSTLRLHVMYIGRPVPAMTWFHGQKLLQNSENITIENTEHYTHLVMKNVQRKTHAGKYKVQLSNVFGTVDAILDVEIQDKPDKPTGPIVIEALLKNSAVISWKPPADDGGSWITNYVVEKCEAKEGAEWQLVSSAISVTTCRIVNLTENAGYYFRVSAQNTFGISDPLEVSSVVIIKSPFEKPGAPGKPTITAVTKDSCVVAWKPPASDGGAKIRNYYLEKREKKQNKWISVTTEEIRETVFSVKNLIEGLEYEFRVKCENLGGESEWSEISEPITPKSDVPIQAPHFKEELRNLNVRYQSNATLVCKVTGHPKPIVKWYRQGKEIIADGLKYRIQEFKGGYHQLIIASVTDDDATVYQVRATNQGGSVSGTASLEVEVPAKIHLPKTLEGMGAVHALRGEVVSIKIPFSGKPDPVITWQKGQDLIDNNGHYQVIVTRSFTSLVFPNGVERKDAGFYVVCAKNRFGIDQKTVELDVADVPDPPRGVKVSDVSRDSVNLTWTEPASDGGSKITNYIVEKCATTAERWLRVGQARETRYTVINLFGKTSYQFRVIAENKFGLSKPSEPSEPTITKEDKTRAMNYDEEVDETREVSMTKASHSSTKELYEKYMIAEDLGRGEFGIVHRCVETSSKKTYMAKFVKVKGTDQVLVKKEISILNIARHRNILHLHESFESMEELVMIFEFISGLDIFERINTSAFELNEREIVSYVHQVCEALQFLHSHNIGHFDIRPENIIYQTRRSSTIKIIEFGQARQLKPGDNFRLLFTAPEYYAPEVHQHDVVSTATDMWSLGTLVYVLLSGINPFLAETNQQIIENIMNAEYTFDEEAFKEISIEAMDFVDRLLVKERKSRMTASEALQHPWLKQKIERVSTKVIRTLKHRRYYHTLIKKDLNMVVSAARISCGGAIRSQKGVSVAKVKVASIEIGPVSGQIMHAVGEEGGHVKYVCKIENYDQSTQVTWYFGVRQLENSEKYEITYEDGVAILYVKDITKLDDGTYRCKVVNDYGEDSSYAELFVKGVREVYDYYCRRTMKKIKRRTDTMRLLERPPEFTLPLYNKTAYVGENVRFGVTITVHPEPHVTWYKSGQKIKPGDNDKKYTFESDKGLYQLTINSVTTDDDAEYTVVARNKYGEDSCKAKLTVTLHPPPTDSTLRPMFKRLLANAECQEGQSVCFEIRVSGIPPPTLKWEKDGQPLSLGPNIEIIHEGLDYYALHIRDTLPEDTGYYRVTATNTAGSTSCQAHLQVERLRYKKQEFKSKEEHERHVQKQIDKTLRMAEILSGTESVPLTQVAKEALREAAVLYKPAVSTKTVKGEFRLEIEEKKEERKLRMPYDVPEPRKYKQTTIEEDQRIKQFVPMSDMKWYKKIRDQYEMPGKLDRVVQKRPKRIRLSRWEQFYVMPLPRITDQYRPKWRIPKLSQDDLEIVRPARRRTPSPDYDFYYRPRRRSLGDISDEELLLPIDDYLAMKRTEEERLRLEEELELGFSASPPSRSPPHFELSSLRYSSPQAHVKVEETRKDFRYSTYHIPTKAEASTSYAELRERHAQAAYRQPKQRQRIMAEREDEELLRPVTTTQHLSEYKSELDFMSKEEKSRKKSRRQREVTEITEIEEEYEISKHAQRESSSSASRLLRRRRSLSPTYIELMRPVSELIRSRPQPAEEYEDDTERRSPTPERTRPRSPSPVSSERSLSRFERSARFDIFSRYESMKAALKTQKTSERKYEVLSQQPFTLDHAPRITLRMRSHRVPCGQNTRFILNVQSKPTAEVKWYHNGVELQESSKIHYTNTSGVLTLEILDCHTDDSGTYRAVCTNYKGEASDYATLDVTGGDYTTYASQRRDEEVPRSVFPELTRTEAYAVSSFKKTSEMEASSSVREVKSQMTETRESLSSYEHSASAEMKSAALEEKSLEEKSTTRKIKTTLAARILTKPRSMTVYEGESARFSCDTDGEPVPTVTWLRKGQVLSTSARHQVTTTKYKSTFEISSVQASDEGNYSVVVENSEGKQEAEFTLTIQKARVTEKAVTSPPRVKSPEPRVKSPEAVKSPKRVKSPEPSHPKAVSPTETKPTPTEKVQHLPVSAPPKITQFLKAEASKEIAKLTCVVESSVLRAKEVTWYKDGKKLKENGHFQFHYSADGTYELKINNLTESDQGEYVCEISGEGGTSKTNLQFMGQAFKSIHEKVSKISETKKSDQKTTESTVTRKTEPKAPEPISSKPVIVTGLQDTTVSSDSVAKFAVKATGEPRPTAIWTKDGKAITQGGKYKLSEDKGGFFLEIHKTDTSDSGLYTCTVKNSAGSVSSSCKLTIKAIKDTEAQKVSTQKTSEITPQKKAVVQEEISQKALRSEEIKMSEAKSQEKLALKEEASKVLISEEVKKSAATSLEKSIVHEEITKTSQASEEVRTHAEIKAFSTQMSINEGQRLVLKANIAGATDVKWVLNGVELTNSEEYRYGVSGSDQTLTIKQASHRDEGILTCISKTKEGIVKCQYDLTLSKELSDAPAFISQPRSQNINEGQNVLFTCEISGEPSPEIEWFKNNLPISISSNVSISRSRNVYSLEIRNASVSDSGKYTIKAKNFRGQCSATASLMVLPLVEEPSREVVLRTSGDTSLQGSFSSQSVQMSASKQEASFSSFSSSSASSMTEMKFASMSAQSMSSMQESFVEMSSSSFMGISNMTQLESSTSKMLKAGIRGIPPKIEALPSDISIDEGKVLTVACAFTGEPTPEVTWSCGGRKIHSQEQGRFHIENTDDLTTLIIMDVQKQDGGLYTLSLGNEFGSDSATVNIHIRSI

SEQ ID NO: 3309 - protein, 33423 aa, Homo sapiens
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIRQETEITAASMVVVATAKSTKLETVPGAQEETTTQQDQMHLSYEKIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDLRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENITSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEAPESILHERIEQEIEMEMKAAPVIKRKIEPLEVALGHLAKFTCEIQSAPNVRFQWFKAGREIYESDKCSIRSSKYISSLEILRTQVVDCGEYTCKASNEYGSVSCTATLTVTEAYPPTFLSRPKSLTTFVGKAAKFICTVTGTPVIETIWQKDGAALSPSPNWRISDAENKHILELSNLTIQDRGVYSCKASNKFGADICQAELIIIDKPHFIKELEPVQSAINKKVHLECQVDEDRKVTVTWSKDGQKLPPGKDYKICFEDKIATLEIPLAKLKDSGTYVCTASNEAGSSSCSATVTVREPPSFVKKVDPSYLMLPGESARLHCKLKGSPVIQVTWFKNNKELSESNTVRMYFVNSEAILDITDVKVEDSGSYSCEAVNDVGSDSCSTEIVIKEPPSFIKTLEPADIVRGTNALLQCEVSGTGPFEISWFKDKKQIRSSKKYRLFSQKSLVCLEIFSFNSADVGEYECVVANEVGKCGCMATHLLKEPPTFVKKVDDLIALGGQTVTLQAAVRGSEPISVTWMKGQEVIREDGKIKMSFSNGVAVLIIPDVQISFGGKYTCLAENEAGSQTSVGELIVKEPAKIIERAELIQVTAGDPATLEYTVAGTPELKPKWYKDGRPLVASKKYRISFKNNVAQLKFYSAELHDSGQYTFEISNEVGSSSCETTFTVLDRDIAPFFTKPLRNVDSVVNGTCRLDCKIAGSLPMRVSWFKDGKEIAASDRYRIAFVEGTASLEIIRVDMNDAGNFTCRATNSVGSKDSSGALIVQEPPSFVTKPGSKDVLPGSAVCLKSTFQGSTPLTIRWFKGNKELVSGGSCYITKEALESSLELYLVKTSDSGTYTCKVSNVAGGVECSANLFVKEPATFVEKLEPSQLLKKGDATQLACKVTGTPPIKITWFANDREIKESSKHRMSFVESTAVLRLTDVGIEDSGEYMCEAQNEAGSDHCSSIVIVKESPYFTKEFKPIEVLKEYDVMLLAEVAGTPPFEITWFKDNTILRSGRKYKTFIQDHLVSLQILKFVAADAGEYQCRVTNEVGSSICSARVTLREPPSFIKKIESTSSLRGGTAAFQATLKGSLPITVTWLKDSDEITEDDNIRMTFENNVASLYLSGIEVKHDGKYVCQAKNDAGIQRCSALLSVKEPATITEEAVSIDVTQGDPATLQVKFSGTKEITAKWFKDGQELTLGSKYKISVTDTVSILKIISTEKKDSGEYTFEVQNDVGRSSCKARINVLDLIIPPSFTKKLKKMDSIKGSFIDLECIVAGSHPISIQWFKDDQEISASEKYKFSFHDNTAFLEISQLEGTDSGTYTCSATNKAGHNQCSGHLTVKEPPYFVEKPQSQDVNPNTRVQLKALVGGTAPMTIKWFKDNKELHSGAARSVWKDDTSTSLELFAAKATDSGTYICQLSNDVGTATSKATLFVKEPPQFIKKPSPVLVLRNGQSTTFECQITGTPKIRVSWYLDGNEITAIQKHGISFIDGLATFQISGARVENSGTYVCEARNDAGTASCSIELKVKEPPTFIRELKPVEVVKYSDVELECEVTGTPPFEVTWLKNNREIRSSKKYTLTDRVSVFNLHITKCDPSDTGEYQCIVSNEGGSCSCSTRVALKEPPSFIKKIENTTTVLKSSATFQSTVAGSPPISITWLKDDQILDEDDNVYISFVDSVATLQIRSVDNGHSGRYTCQAKNESGVERCYAFLLVQEPAQIVEKAKSVDVTEKDPMTLECVVAGTPELKVKWLKDGKQIVPSRYFSMSFENNVASFRIQSVMKQDSGQYTFKVENDFGSSSCDAYLRVLDQNIPPSFTKKLTKMDKVLGSSIHMECKVSGSLPISAQWFKDGKEISTSAKYRLVCHERSVSLEVNNLELEDTANYTCKVSNVAGDDACSGILTVKEPPSFLVKPGRQQAIPDSTVEFKAILKGTPPFKIKWFKDDVELVSGPKCFIGLEGSTSFLNLYSVDASKTGQYTCHVTNDVGSDSCTTMLLVTEPPKFVKKLEASKIVKAGDSSRLECKIAGSPEIRVVWFRNEHELPASDKYRMTFIDSVAVIQMNNLSTEDSGDFICEAQNPAGSTSCSTKVIVKEPPVFSSFPPIVETLKNAEVSLECELSGTPPFEVVWYKDKRQLRSSKKYKIASKNFHTSIHILNVDTSDIGEYHCKAQNEVGSDTCVCTVKLKEPPRFVSKLNSLTVVAGEPAELQASIEGAQPIFVQWLKEKEEVIRESENIRITFVENVATLQFAKAEPANAGKYICQIKNDGGMEENMATLMVLEPAVIVEKAGPMTVTVGETCTLECKVAGTPELSVEWYKDGKLLTSSQKHKFSFYNKISSLRILSVERQDAGTYTFQVQNNVGKSSCTAVVDVSDRAVPPSFTRRLKNTGGVLGASCILECKVAGSSPISVAWFHEKTKIVSGAKYQTTFSDNVCTLQLNSLDSSDMGNYTCVAANVAGSDECRAVLTVQEPPSFVKEPEPLEVLPGKNVTFTSVIRGTPPFKVNWFRGARELVKGDRCNIYFEDTVAELELFNIDISQSGEYTCVVSNNAGQASCTTRLFVKEPAAFLKRLSDHSVEPGKSIILESTYTGTLPISVTWKKDGFNITTSEKCNIVTTEKTCILEILNSTKRDAGQYSCEIENEAGRDVCGALVSTLEPPYFVTELEPLEAAVGDSVSLQCQVAGTPEITVSWYKGDTKLRPTPEYRTYFTNNVATLVFNKVNINDSGEYTCKAENSIGTASSKTVFRIQERQLPPSFARQLKDIEQTVGLPVTLTCRLNGSAPIQVCWYRDGVLLRDDENLQTSFVDNVATLKILQTDLSHSGQYSCSASNPLGTASSSARLTAREPKKSPFFDIKPVSIDVIAGESADFECHVTGAQPMRITWSKDNKEIRPGGNYTITCVGNTPHLRILKVGKGDSGQYTCQATNDVGKDMCSAQLSVKEPPKFVKKLEASKVAKQGESIQLECKISGSPEIKVSWFRNDSELHESWKYNMSFINSVALLTINEASAEDSGDYICEAHNGVGDASCSTALTVKAPPVFTQKPSPVGALKGSDVILQCEISGTPPFEVVWVKDRKQVRNSKKFKITSKHFDTSLHILNLEASDVGEYHCKATNEVGSDTCSCSVKFKEPPRFVKKLSDTSTLIGDAVELRAIVEGFQPISVVWLKDRGEVIRESENTRISFIDNIATLQLGSPEASNSGKYICQIKNDAGMRECSAVLTVLEPARIIEKPEPMTVTTGNPFALECVVTGTPELSAKWFKDGRELSADSKHHITFINKVASLKIPCAEMSDKGLYSFEVKNSVGKSNCTVSVHVSDRIVPPSFIRKLKDVNAILGASVVLECRVSGSAPISVGWFQDGNEIVSGPKCQSSFSENVCTLNLSLLEPSDTGIYTCVAANVAGSDECSAVLTVQEPPSFEQTPDSVEVLPGMSLTFTSVIRGTPPFKVKWFKGSRELVPGESCNISLEDFVTELELFEVQPLESGDYSCLVTNDAGSASCTTHLFVKEPATFVKRLADFSVETGSPIVLEATYTGTPPISVSWIKDEYLISQSERCSITMTEKSTILEILESTIEDYAQYSCLIENEAGQDICEALVSVLEPPYFIEPLEHVEAVIGEPATLQCKVDGTPEIRISWYKEHTKLRSAPAYKMQFKNNVASLVINKVDHSDVGEYSCKADNSVGAVASSAVLVIKERKLPPFFARKLKDVHETLGFPVAFECRINGSEPLQVSWYKDGVLLKDDANLQTSFVHNVATLQILQTDQSHIGQYNCSASNPLGTASSSAKLILSEHEVPPFFDLKPVSVDLALGESGTFKCHVTGTAPIKITWAKDNREIRPGGNYKMTLVENTATLTVLKVGKGDAGQYTCYASNIAGKDSCSAHLGVQEPPRFIKKLEPSRIVKQDEFTRYECKIGGSPEIKVLWYKDETEIQESSKFRMSFVDSVAVLEMHNLSVEDSGDYTCEAHNAAGSASSSTSLKVKEPPIFRKKPHPIETLKGADVHLECELQGTPPFHVSWYKDKRELRSGKKYKIMSENFLTSIHILNVDAADIGEYQCKATNDVGSDTCVGSIALKAPPRFVKKLSDISTVVGKEVQLQTTIEGAEPISVVWFKDKGEIVRESDNIWISYSENIATLQFSRVEPANAGKYTCQIKNDAGMQECFATLSVLEPATIVEKPESIKVTTGDTCTLECTVAGTPELSTKWFKDGKELTSDNKYKISFFNKVSGLKIINVAPSDSGVYSFEVQNPVGKDSCTASLQVSDRTVPPSFTRKLKETNGLSGSSVVMECKVYGSPPISVSWFHEGNEISSGRKYQTTLTDNTCALTVNMLEESDSGDYTCIATNMAGSDECSAPLTVREPPSFVQKPDPMDVLTGTNVTFTSIVKGTPPFSVSWFKGSSELVPGDRCNVSLEDSVAELELFDVDTSQSGEYTCIVSNEAGKASCTTHLYIKAPAKFVKRLNDYSIEKGKPLILEGTFTGTPPISVTWKKNGINVTPSQRCNITTTEKSAILEIPSSTVEDAGQYNCYIENASGKDSCSAQILILEPPYFVKQLEPVKVSVGDSASLQCQLAGTPEIGVSWYKGDTKLRPTTTYKMHFRNNVATLVFNQVDINDSGEYICKAENSVGEVSASTFLTVQEQKLPPSFSRQLRDVQETVGLPVVFDCAISGSEPISVSWYKDGKPLKDSPNVQTSFLDNTATLNIFKTDRSLAGQYSCTATNPIGSASSSARLILTEGKNPPFFDIRLAPVDAVVGESADFECHVTGTQPIKVSWAKDSREIRSGGKYQISYLENSAHLTVLKVDKGDSGQYTCYAVNEVGKDSCTAQLNIKERLIPPSFTKRLSETVEETEGNSFKLEGRVAGSQPITVAWYKNNIEIQPTSNCEITFKNNTLVLQVRKAGMNDAGLYTCKVSNDAGSALCTSSIVIKEPKKPPVFDQHLTPVTVSEGEYVQLSCHVQGSEPIRIQWLKAGREIKPSDRCSFSFASGTAVLELRDVAKADSGDYVCKASNVAGSDTTKSKVTIKDKPAVAPATKKAAVDGRLFFVSEPQSIRVVEKTTATFIAKVGGDPIPNVKWTKGKWRQLNQGGRVFIHQKGDEAKLEIRDTTKTDSGLYRCVAFNEHGEIESNVNLQVDERKKQEKIEGDLRAMLKKTPILKKGAGEEEEIDIMELLKNVDPKEYEKYARMYGITDFRGLLQAFELLKQSQEEETHRLEIEEIERSERDEKEFEELVSFIQQRLSQTEPVTLIKDIENQTVLKDNDAVFEIDIKINYPEIKLSWYKGTEKLEPSDKFEISIDGDRHTLRVKNCQLKDQGNYRLVCGPHIASAKLTVIEPAWERHLQDVTLKEGQTCTMTCQFSVPNVKSEWFRNGRILKPQGRHKTEVEHKVHKLTIADVRAEDQGQYTCKYEDLETSAELRIEAEPIQFTKRIQNIVVSEHQSATFECEVSFDDAIVTWYKGPTELTESQKYNFRNDGRCHYMTIHNVTPDDEGVYSVIARLEPRGEARSTAELYLTTKEIKLELKPPDIPDSRVPIPTMPIRAVPPEEIPPVVAPPIPLLLPTPEEKKPPPKRIEVTKKAVKKDAKKVVAKPKEMTPREEIVKKPPPPTTLIPAKAPEIIDVSSKAEEVKIMTITRKKEVQKEKEAVYEKKQAVHKEKRVFIESFEEPYDELEVEPYTEPFEQPYYEEPDEDYEEIKVEAKKEVHEEWEEDFEEGQEYYEREEGYDEGEEEWEEAYQEREVIQVQKEVYEESHERKVPAKVPEKKAPPPPKVIKKPVIEKIEKTSRRMEEEKVQVTKVPEVSKKIVPQKPSRTPVQEEVIEVKVPAVHTKKMVISEEKMFFASHTEEEVSVTVPEVQKEIVTEEKIHVAVSKRVEPPPKVPELPEKPAPEEVAPVPIPKKVEPPAPKVPEVPKKPVPEEKKPVPVPKKEPAAPPKVPEVPKKPVPEEKIPVPVAKKKEAPPAKVPEVQKRVVTEEKITIVTQREESPPPAVPEIPKKKVPEERKPVPRKEEEVPPPPKVPALPKKPVPEEKVAVPVPVAKKAPPPRAEVSKKTVVEEKRFVAEEKLSFAVPQRVEVTRHEVSAEEEWSYSEEEEGVSISVYREEEREEEEEAEVTEYEVMEEPEEYVVEEKLHIISKRVEAEPAEVTERQEKKIVLKPKIPAKIEEPPPAKVPEAPKKIVPEKKVPAPVPKKEKVPPPKVPEEPKKPVPEKKVPPKVIKMEEPLPAKVTERHMQITQEEKVLVAVTKKEAPPKARVPEEPKRAVPEEKVLKLKPKREEEPPAKVTEFRKRVVKEEKVSIEAPKREPQPIKEVTIMEEKERAYTLEEEAVSVQREEEYEEYEEYDYKEFEEYEPTEEYDQYEEYEEREYERYEEHEEYITEPEKPIPVKPVPEEPVPTKPKAPPAKVLKKAVPEEKVPVPIPKKLKPPPPKVPEEPKKVFEEKIRISITKREKEQVTEPAAKVPMKPKRVVAEEKVPVPRKEVAPPVRVPEVPKELEPEEVAFEEEVVTHVEEYLVEEEEEYIHEEEEFITEEEVVPVIPVKVPEVPRKPVPEEKKPVPVPKKKEAPPAKVPEVPKKPEEKVPVLIPKKEKPPPAKVPEVPKKPVPEEKVPVPVPKKVEAPPAKVPEVPKKPVPEKKVPVPAPKKVEAPPAKVPEVPKKLIPEEKKPTPVPKKVEAPPPKVPKKREPVPVPVALPQEEEVLFEEEIVPEEEVLPEEEEVLPEEEEVLPEEEEVLPEEEEIPPEEEEVPPEEEYVPEEEEFVPEEEVLPEVKPKVPVPAPVPEIKKKVTEKKVVIPKKEEAPPAKVPEVPKKVEEKRIILPKEEEVLPVEVTEEPEEEPISEEEIPEEPPSIEEVEEVAPPRVPEVIKKAVPEAPTPVPKKVEAPPAKVSKKIPEEKVPVPVQKKEAPPAKVPEVPKKVPEKKVLVPKKEAVPPAKGRTVLEEKVSVAFRQEVVVKERLELEVVEAEVEEIPEEEEFHEVEEYFEEGEFHEVEEFIKLEQHRVEEEHRVEKVHRVIEVFEAEEVEVFEKPKAPPKGPEISEKIIPPKKPPTKVVPRKEPPAKVPEVPKKIVVEEKVRVPEEPRVPPTKVPDVLPPKEVVPEKKVPVPPAKKPEAPPPKVPEAPKEVVPEKKVPVPPPKKPEVPPTKVPEVPKAAVPEKKVPEAIPPKPESPPPEVPEAPKEVVPEKKVPAAPPKKPEVTPVKVPEAPKEVVPEKKVPVPPPKKPEVPPTKVPEVPKVAVPEKKVPEAIPPKPESPPPEVFEEPEEVALEEPPAEVVEEPEPAAPPQVTVPPKKPVPEKKAPAVVAKKPELPPVKVPEVPKEVVPEKKVPLVVPKKPEAPPAKVPEVPKEVVPEKKVAVPKKPEVPPAKVPEVPKKPVLEEKPAVPVPERAESPPPEVYEEPEEIAPEEEIAPEEEKPVPVAEEEEPEVPPPAVPEEPKKIIPEKKVPVIKKPEAPPPKEPEPEKVIEKPKLKPRPPPPPPAPPKEDVKEKIFQLKAIPKKKVPEKPQVPEKVELTPLKVPGGEKKVRKLLPERKPEPKEEVVLKSVLRKRPEEEEPKVEPKKLEKVKKPAVPEPPPPKPVEEVEVPTVTKRERKIPEPTKVPEIKPAIPLPAPEPKPKPEAEVKTIKPPPVEPEPTPIAAPVTVPVVGKKAEAKAPKEEAAKPKGPIKGVPKKTPSPIEAERRKLRPGSGGEKPPDEAPFTYQLKAVPLKFVKEIKDIILTESEFVGSSAIFECLVSPSTAITTWMKDGSNIRESPKHRFIADGKDRKLHIIDVQLSDAGEYTCVLRLGNKEKTSTAKLVVEELPVRFVKTLEEEVTVVKGQPLYLSCELNKERDVVWRKDGKIVVEKPGRIVPGVIGLMRALTINDADDTDAGTYTVTVENANNLECSSCVKVVEVIRDWLVKPIRDQHVKPKGTAIFACDIAKDTPNIKWFKGYDEIPAEPNDKTEILRDGNHLYLKIKNAMPEDIAEYAVEIEGKRYPAKLTLGEREVELLKPIEDVTIYEKESASFDAEISEADIPGQWKLKGELLRPSPTCEIKAEGGKRFLTLHKVKLDQAGEVLYQALNAITTAILTVKEIELDFAVPLKDVTVPERRQARFECVLTREANVIWSKGPDIIKSSDKFDIIADGKKHILVINDSQFDDEGVYTAEVEGKKTSARLFVTGIRLKFMSPLEDQTVKEGETATFVCELSHEKMHVVWFKNDAKLHTSRTVLISSEGKTHKLEMKEVTLDDISQIKAQVKELSSTAQLKVLEADPYFTVKLHDKTAVEKDEITLKCEVSKDVPVKWFKDGEEIVPSPKYSIKADGLRRILKIKKADLKDKGEYVCDCGTDKTKANVTVEARLIKVEKPLYGVEVFVGETAHFEIELSEPDVHGQWKLKGQPLTASPDCEIIEDGKKHILILHNCQLGMTGEVSFQAANAKSAANLKVKELPLIFITPLSDVKVFEKDEAKFECEVSREPKTFRWLKGTQEITGDDRFELIKDGTKHSMVIKSAAFEDEAKYMFEAEDKHTSGKLIIEGIRLKFLTPLKDVTAKEKESAVFTVELSHDNIRVKWFKNDQRLHTTRSVSMQDEGKTHSITFKDLSIDDTSQIRVEAMGMSSEAKLTVLEGDPYFTGKLQDYTGVEKDEVILQCEISKADAPVKWFKDGKEIKPSKNAVIKADGKKRMLILKKALKSDIGQYTCDCGTDKTSGKLDIEDREIKLVRPLHSVEVMETETARFETEISEDDIHANWKLKGEALLQTPDCEIKEEGKIHSLVLHNCRLDQTGGVDFQAANVKSSAHLRVKPRVIGLLRPLKDVTVTAGETATFDCELSYEDIPVEWYLKGKKLEPSDKVVPRSEGKVHTLTLRDVKLEDAGEVQLTAKDFKTHANLFVKEPPVEFTKPLEDQTVEEGATAVLECEVSRENAKVKWFKNGTEILKSKKYEIVADGRVRKLVIHDCTPEDIKTYTCDAKDFKTSCNLNVVPPHVEFLRPLTDLQVREKEMARFECELSRENAKVKWFKDGAEIKKGKKYDIISKGAVRILVINKCLLDDEAEYSCEVRTARTSGMLTVLEEEAVFTKNLANIEVSETDTIKLVCEVSKPGAEVIWYKGDEEIIETGRYEILTEGRKRILVIQNAHLEDAGNYNCRLPSSRTDGKVKVHELAAEFISKPQNLEILEGEKAEFVCSISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPLKDIETMEKKSVTFWCKVNRLNVTLKWTKNGEEVPFDNRVSYRVDKYKHMLTIKDCGFPDEGEYIVTAGQDKSVAELLIIEAPTEFVEHLEDQTVTEFDDAVFSCQLSREKANVKWYRNGREIKEGKKYKFEKDGSIHRLIIKDCRLDDECEYACGVEDRKSRARLFVEEIPVEIIRPPQDILEAPGADVVFLAELNKDKVEVQWLRNNMVVVQGDKHQMMSEGKIHRLQICDIKPRDQGEYRFIAKDKEARAKLELAAAPKIKTADQDLVVDVGKPLTMVVPYDAYPKAEAEWFKENEPLSTKTIDTTAEQTSFRILEAKKGDKGRYKIVLQNKHGKAEGFINLKVIDVPGPVRNLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFVEPTMDLSAFKDGLEVIVPNPITILVPSTGYPRPTATWCFGDKVLETGDRVKMKTLSAYAELVISPSERSDKGIYTLKLENRVKTISGEIDVNVIARPSAPKELKFGDITKDSVHLTWEPPDDDGGSPLTGYVVEKREVSRKTWTKVMDFVTDLEFTVPDLVQGKEYLFKVCARNKCGPGEPAYVDEPVNMSTPATVPDPPENVKWRDRTANSIFLTWDPPKNDGGSRIKGYIVERCPRGSDKWVACGEPVAETKMEVTGLEEGKWYAYRVKALNRQGASKPSRPTEEIQAVDTQEAPEIFLDVKLLAGLTVKAGTKIELPATVTGKPEPKITWTKADMILKQDKRITIENVPKKSTVTIVDSKRSDTGTYIIEAVNVCGRATAVVEVNVLDKPGPPAAFDITDVTNESCLLTWNPPRDDGGSKITNYVVERRATDSEVWHKLSSTVKDTNFKATKLIPNKEYIFRVAAENMYGVGEPVQASPITAKYQFDPPGPPTRLEPSDITKDAVTLTWCEPDDDGGSPITGYWVERLDPDTDKWVRCNKMPVKDTTYRVKGLTNKKKYRFRVLAENLAGPGKPSKSTEPILIKDPIDPPWPPGKPTVKDVGKTSVRLNWTKPEHDGGAKIESYVIEMLKTGTDEWVRVAEGVPTTQHLLPGLMEGQEYSFRVRAVNKAGESEPSEPSDPVLCREKLYPPSPPRWLEVINITKNTADLKWTVPEKDGGSPITNYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWVKAGKTAGPDCNFRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKPTIDLETHDIIVIEGEKLSIPVPFRAVPVPTVSWHKDGKEVKASDRLTMKNDHISAHLEVPKSVRADAGIYTITLENKLGSATASINVKVIGLPGPCKDIKASDITKSSCKLTWEPPEFDGGTPILHYVLERREAGRRTYIPVMSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRATPPTKAVDPIDAPKVILRTSLEVKRGDEIALDASISGSPYPTITWIKDENVIVPEEIKKRAAPLVRRRKGEVQEEEPFVLPLTQRLSIDNSKKGESQLRVRDSLRPDHGLYMIKVENDHGIAKAPCTVSVLDTPGPPINFVFEDIRKTSVLCKWEPPLDDGGSEIINYTLEKKDKTKPDSEWIVVTSTLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPISPPGPPIPRVTDTSSTTIELEWEPPAFNGGGEIVGYFVDKQLVGTNEWSRCTEKMIKVRQYTVKEIREGADYKLRVSAVNAAGEGPPGETQPVTVAEPQEPPAVELDVSVKGGIQIMAGKTLRIPAVVTGRPVPTKVWTKEEGELDKDRVVIDNVGTKSELIIKDALRKDHGRYVITATNSCGSKFAAARVEVFDVPGPVLDLKPVVTNRKMCLLNWSDPEDDGGSEITGFIIERKDAKMHTWRQPIETERSKCDITGLLEGQEYKFRVIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKGTYTVTASNRLGSVFRNVHVEVYDRPSPPRNLAVTDIKAESCYLTWDAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKIGLITKNTVHLSWKPPKNDGGSPVTHYIVECLAWDPTGTKKEAWRQCNKRDVEELQFTVEDLVEGGEYEFRVKAVNAAGVSKPSATVGPCDCQRPDMPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFRVSAVNIAGIGEPGEVTDVIEMKDRLVSPDLQLDASVRDRIVVHAGGVIRIIAYVSGKPPPTVTWNMNERTLPQEATIETTAISSSMVIKNCQRSHQGVYSLLAKNEAGERKKTIIVDVLDVPGPVGTPFLAHNLTNESCKLTWFSPEDDGGSPITNYVIEKRESDRRAWTPVTYTVTRQNATVQGLIQGKAYFFRIAAENSIGMGPFVETSEALVIREPITVPERPEDLEVKEVTKNTVTLTWNPPKYDGGSEIINYVLESRLIGTEKFHKVTNDNLLSRKYTVKGLKEGDTYEYRVSAVNIVGQGKPSFCTKPITCKDELAPPTLHLDFRDKLTIRVGEAFALTGRYSGKPKPKVSWFKDEADVLEDDRTHIKTTPATLALEKIKAKRSDSGKYCVVVENSTGSRKGFCQVNVVDRPGPPVGPVSFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFPKVTWKKEDRDAPTKARIDVTPVGSKLEIRNAAHEDGGIYSLTVENPAGSKTVSVKVLVLDKPGPPRDLEVSEIRKDSCYLTWKEPLDDGGSVITNYVVERRDVASAQWSPLSATSKKKSHFAKHLNEGNQYLFRVAAENQYGRGPFVETPKPIKALDPLHPPGPPKDLHHVDVDKTEVSLVWNKPDRDGGSPITGYLVEYQEEGTQDWIKFKTVTNLECVVTGLQQGKTYRFRVKAENIVGLGLPDTTIPIECQEKLVPPSVELDVKLIEGLVVKAGTTVRFPAIIRGVPVPTAKWTTDGSEIKTDEHYTVETDNFSSVLTIKNCLRRDTGEYQITVSNAAGSKTVAVHLTVLDVPGPPTGPINILDVTPEHMTISWQPPKDDGGSPVINYIVEKQDTRKDTWGVVSSGSSKTKLKIPHLQKGCEYVFRVRAENKIGVGPPLDSTPTVAKHKFSPPSPPGKPVVTDITENAATVSWTLPKSDGGSPITGYYMERREVTGKWVRVNKTPIADLKFRVTGLYEGNTYEFRVFAENLAGLSKPSPSSDPIKACRPIKPPGPPINPKLKDKSRETADLVWTKPLSDGGSPILGYVVECQKPGTAQWNRINKDELIRQCAFRVPGLIEGNEYRFRIKAANIVGEGEPRELAESVIAKDILHPPEVELDVTCRDVITVRVGQTIRILARVKGRPEPDITWTKEGKVLVREKRVDLIQDLPRVELQIKEAVRADHGKYIISAKNSSGHAQGSAIVNVLDRPGPCQNLKVTNVTKENCTISWENPLDNGGSEITNFIVEYRKPNQKGWSIVASDVTKRLIKANLLANNEYYFRVCAENKVGVGPTIETKTPILAINPIDRPGEPENLHIADKGKTFVYLKWRRPDYDGGSPNLSYHVERRLKGSDDWERVHKGSIKETHYMVDRCVENQIYEFRVQTKNEGGESDWVKTEEVVVKEDLQKPVLDLKLSGVLTVKAGDTIRLEAGVRGKPFPEVAWTKDKDATDLTRSPRVKIDTRADSSKFSLTKAKRSDGGKYVVTATNTAGSFVAYATVNVLDKPGPVRNLKIVDVSSDRCTVCWDPPEDDGGCEIQNYILEKCETKRMVWSTYSATVLTPGTTVTRLIEGNEYIFRVRAENKIGTGPPTESKPVIAKTKYDKPGRPDPPEVTKVSKEEMTVVWNPPEYDGGKSITGYFLEKKEKHSTRWVPVNKSAIPERRMKVQNLLPDHEYQFRVKAENEIGIGEPSLPSRPVVAKDPIEPPGPPTNFRVVDTTKHSITLGWGKPVYDGGAPIIGYVVEMRPKIADASPDEGWKRCNAAAQLVRKEFTVTSLDENQEYEFRVCAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVNPAGEKAVFVNVRVLDTPGPVSDLKVSDVTKTSCHVSWAPPENDGGSQVTHYIVEKREADRKTWSTVTPEVKKTSFHVTNLVPGNEYYFRVTAVNEYGPGVPTDVPKPVLASDPLSEPDPPRKLEVTEMTKNSATLAWLPPLRDGGAKIDGYITSYREEEQPADRWTEYSVVKDLSLVVTGLKEGKKYKFRVAARNAVGVSLPREAEGVYEAKEQLLPPKILMPEQITIKAGKKLRIEAHVYGKPHPTCKWKKGEDEVVTSSHLAVHKADSSSILIIKDVTRKDSGYYSLTAENSSGTDTQKIKVVVMDAPGPPQPPFDISDIDADACSLSWHIPLEDGGSNITNYIVEKCDVSRGDWVTALASVTKTSCRVGKLIPGQEYIFRVRAENRFGISEPLTSPKMVAQFPFGVPSEPKNARVTKVNKDCIFVAWDRPDSDGGSPIIGYLIERKERNSLLWVKANDTLVRSTEYPCAGLVEGLEYSFRIYALNKAGSSPPSKPTEYVTARMPVDPPGKPEVIDVTKSTVSLIWARPKHDGGSKIIGYFVEACKLPGDKWVRCNTAPHQIPQEEYTATGLEEKAQYQFRAIARTAVNISPPSEPSDPVTILAENVPPRIDLSVAMKSLLTVKAGTNVCLDATVFGKPMPTVSWKKDGTLLKPAEGIKMAMQRNLCTLELFSVNRKDSGDYTITAENSSGSKSATIKLKVLDKPGPPASVKINKMYSDRAMLSWEPPLEDGGSEITNYIVDKRETSRPNWAQVSATVPITSCSVEKLIEGHEYQFRICAENKYGVGDPVFTEPAIAKNPYDPPGRCDPPVISNITKDHMTVSWKPPADDGGSPITGYLLEKRETQAVNWTKVNRKPIIERTLKATGLQEGTEYEFRVTAINKAGPGKPSDASKAAYARDPQYPPAPPAFPKVYDTTRSSVSLSWGKPAYDGGSPIIGYLVEVKRADSDNWVRCNLPQNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVLDTPGPPVNVTVKEISKDSAYVTWEPPIIDGGSPIINYVVQKRDAERKSWSTVTTECSKTSFRVANLEEGKSYFFRVFAENEYGIGDPGETRDAVKASQTPGPVVDLKVRSVSKSSCSIGWKKPHSDGGSRIIGYVVDFLTEENKWQRVMKSLSLQYSAKDLTEGKEYTFRVSAENENGEGTPSEITVVARDDVVAPDLDLKGLPDLCYLAKENSNFRLKIPIKGKPAPSVSWKKGEDPLATDTRVSVESSAVNTTLIVYDCQKSDAGKYTITLKNVAGTKEGTISIKVVGKPGIPTGPIKFDEVTAEAMTLKWAPPKDDGGSEITNYILEKRDSVNNKWVTCASAVQKTTFRVTRLHEGMEYTFRVSAENKYGVGEGLKSEPIVARHPFDVPDAPPPPNIVDVRHDSVSLTWTDPKKTGGSPITGYHLEFKERNSLLWKRANKTPIRMRDFKVTGLTEGLEYEFRVMAINLAGVGKPSLPSEPVVALDPIDPPGKPEVINITRNSVTLIWTEPKYDGGHKLTGYIVEKRDLPSKSWMKANHVNVPECAFTVTDLVEGGKYEFRIRAKNTAGAISAPSESTETIICKDEYEAPTIVLDPTIKDGLTIKAGDTIVLNAISILGKPLPKSSWSKAGKDIRPSDITQITSTPTSSMLTIKYATRKDAGEYTITATNPFGTKVEHVKVTVLDVPGPPGPVEISNVSAEKATLTWTPPLEDGGSPIKSYILEKRETSRLLWTVVSEDIQSCRHVATKLIQGNEYIFRVSAVNHYGKGEPVQSEPVKMVDRFGPPGPPEKPEVSNVTKNTATVSWKRPVDDGGSEITGYHVERREKKSLRWVRAIKTPVSDLRCKVTGLQEGSTYEFRVSAENRAGIGPPSEASDSVLMKDAAYPPGPPSNPHVTDTTKKSASLAWGKPHYDGGLEITGYVVEHQKVGDEAWIKDTTGTALRITQFVVPDLQTKEKYNFRISAINDAGVGEPAVIPDVEIVEREMAPDFELDAELRRTLVVRAGLSIRIFVPIKGRPAPEVTWTKDNINLKNRANIENTESFTLLIIPECNRYDTGKFVMTIENPAGKKSGFVNVRVLDTPGPVLNLRPTDITKDSVTLHWDLPLIDGGSRITNYIVEKREATRKSYSTATTKCHKCTYKVTGLSEGCEYFFRVMAENEYGIGEPTETTEPVKASEAPSPPDSLNIMDITKSTVSLAWPKPKHDGGSKITGYVIEAQRKGSDQWTHITTVKGLECVVRNLTEGEEYTFQVMAVNSAGRSAPRESRPVIVKEQTMLPELDLRGIYQKLVIAKAGDNIKVEIPVLGRPKPTVTWKKGDQILKQTQRVNFETTATSTILNINECVRSDSGPYPLTARNIVGEVGDVITIQVHDIPGPPTGPIKFDEVSSDFVTFSWDPPENDGGVPISNYVVEMRQTDSTTWVELATTVIRTTYKATRLTTGLEYQFRVKAQNRYGVGPGITSACIVANYPFKVPGPPGTPQVTAVTKDSMTISWHEPLSDGGSPILGYHVERKERNGILWQTVSKALVPGNIFKSSGLTDGIAYEFRVIAENMAGKSKPSKPSEPMLALDPIDPPGKPVPLNITRHTVTLKWAKPEYTGGFKITSYIVEKRDLPNGRWLKANFSNILENEFTVSGLTEDAAYEFRVIAKNAAGAISPPSEPSDAITCRDDVEAPKIKVDVKFKDTVILKAGEAFRLEADVSGRPPPTMEWSKDGKELEGTAKLEIKIADFSTNLVNKDSTRRDSGAYTLTATNPGGFAKHIFNVKVLDRPGPPEGPLAVTEVTSEKCVLSWFPPLDDGGAKIDHYIVQKRETSRLAWTNVASEVQVTKLKVTKLLKGNEYIFRVMAVNKYGVGEPLESEPVLAVNPYGPPDPPKNPEVTTITKDSMVVCWGHPDSDGGSEIINYIVERRDKAGQRWIKCNKKTLTDLRYKVSGLTEGHEYEFRIMAENAAGISAPSPTSPFYKACDTVFKPGPPGNPRVLDTSRSSISIAWNKPIYDGGSEITGYMVEIALPEEDEWQIVTPPAGLKATSYTITGLTENQEYKIRIYAMNSEGLGEPALVPGTPKAEDRMLPPEIELDADLRKVVTIRACCTLRLFVPIKGRPAPEVKWARDHGESLDKASIESTSSYTLLIVGNVNRFDSGKYILTVENSSGSKSAFVNVRVLDTPGPPQDLKVKEVTKTSVTLTWDPPLLDGGSKIKNYIVEKRESTRKAYSTVATNCHKTSWKVDQLQEGCSYYFRVLAENEYGIGLPAETAESVKASERPLPPGKITLMDVTRNSVSLSWEKPEHDGGSRILGYIVEMQTKGSDKWATCATVKVTEATITGLIQGEEYSFRVSAQNEKGISDPRQLSVPVIAKDLVIPPAFKLLFNTFTVLAGEDLKVDVPFIGRPTPAVTWHKDNVPLKQTTRVNAESTENNSLLTIKDACREDVGHYVVKLTNSAGEAIETLNVIVLDKPGPPTGPVKMDEVTADSITLSWGPPKYDGGSSINNYIVEKRDTSTTTWQIVSATVARTTIKACRLKTGCEYQFRIAAENRYGKSTYLNSEPTVAQYPFKVPGPPGTPVVTLSSRDSMEVQWNEPISDGGSRVIGYHLERKERNSILWVKLNKTPIPQTKFKTTGLEEGVEYEFRVSAENIVGIGKPSKVSECYVARDPCDPPGRPEAIIVTRNSVTLQWKKPTYDGGSKITGYIVEKKELPEGRWMKASFTNIIDTHFEVTGLVEDHRYEFRVIARNAAGVFSEPSESTGAITARDEVDPPRISMDPKYKDTIVVHAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQDGGSDIINYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSPPSAYQKACDPIYKPGPPNNPKVIDITRSSVFLSWSKPIYDGGCEIQGYIVEKCDVSVGEWTMCTPPTGINKTNIEVEKLLEKHEYNFRICAINKAGVGEHADVPGPIIVEEKLEAPDIDLDLELRKIINIRAGGSLRLFVPIKGRPTPEVKWGKVDGEIRDAAIIDVTSSFTSLVLDNVNRYDSGKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPISGRPKPTITWTKDGLPLKQTTRINVTDSLDLTTLSIKETHKDDGGQYGITVANVVGQKTASIEIVTLDKPDPPKGPVKFDDVSAESITLSWNPPLYTGGCQITNYIVQKRDTTTTVWDVVSATVARTTLKVTKLKTGTEYQFRIFAENRYGQSFALESDPIVAQYPYKEPGPPGTPFATAISKDSMVIQWHEPVNNGGSPVIGYHLERKERNSILWTKVNKTIIHDTQFKAQNLEEGIEYEFRVYAENIVGVGKASKNSECYVARDPCDPPGTPEPIMVKRNEITLQWTKPVYDGGSMITGYIVEKRDLPDGRWMKASFTNVIETQFTVSGLTEDQRYEFRVIAKNAAGAISKPSDSTGPITAKDEVELPRISMDPKFRDTIVVNAGETFRLEADVHGKPLPTIEWLRGDKEIEESARCEIKNTDFKALLIVKDAIRIDGGQYILRASNVAGSKSFPVNVKVLDRPGPPEGPVQVTGVTSEKCSLTWSPPLQDGGSDISHYVVEKRETSRLAWTVVASEVVTNSLKVTKLLEGNEYVFRIMAVNKYGVGEPLESAPVLMKNPFVLPGPPKSLEVTNIAKDSMTVCWNRPDSDGGSEIIGYIVEKRDRSGIRWIKCNKRRITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENEFGVGVPVETVDAVKAAEPPSPPGKVTLTDVSQTSASLMWEKPEHDGGSRVLGYVVEMQPKGTEKWSIVAESKVCNAVVTGLSSGQEYQFRVKAYNEKGKSDPRVLGVPVIAKDLTIQPSLKLPFNTYSIQAGEDLKIEIPVIGRPRPNISWVKDGEPLKQTTRVNVEETATSTVLHIKEGNKDDFGKYTVTATNSAGTATENLSVIVLEKPGPPVGPVRFDEVSADFVVISWEPPAYTGGCQISNYIVEKRDTTTTTWHMVSATVARTTIKITKLKTGTEYQFRIFAENRYGKSAPLDSKAVIVQYPFKEPGPPGTPFVTSISKDQMLVQWHEPVNDGGTKIIGYHLEQKEKNSILWVKLNKTPIQDTKFKTTGLDEGLEYEFKVSAENIVGIGKPSKVSECFVARDPCDPPGRPEAIVITRNNVTLKWKKPAYDGGSKITGYIVEKKDLPDGRWMKASFTNVLETEFTVSGLVEDQRYEFRVIARNAAGNFSEPSDSSGAITARDEIDAPNASLDPKYKDVIVVHAGETFVLEADIRGKPIPDVVWSKDGKELEETAARMEIKSTIQKTTLVVKDCIRTDGGQYILKLSNVGGTKSIPITVKVLDRPGPPEGPLKVTGVTAEKCYLAWNPPLQDGGANISHYIIEKRETSRLSWTQVSTEVQALNYKVTKLLPGNEYIFRVMAVNKYGIGEPLESGPVTACNPYKPPGPPSTPEVSAITKDSMVVTWARPVDDGGTEIEGYILEKRDKEGVRWTKCNKKTLTDLRLRVTGLTEGHSYEFRVAAENAAGVGEPSEPSVFYRACDALYPPGPPSNPKVTDTSRSSVSLAWSKPIYDGGAPVKGYVVEVKEAAADEWTTCTPPTGLQGKQFTVTKLKENTEYNFRICAINSEGVGEPATLPGSVVAQERIEPPEIELDADLRKVVVLRASATLRLFVTIKGRPEPEVKWEKAEGILTDRAQIEVTSSFTMLVIDNVTRFDSGRYNLTLENNSGSKTAFVNVRVLDSPSAPVNLTIREVKKDSVTLSWEPPLIDGGAKITNYIVEKRETTRKAYATITNNCTKTTFRIENLQEGCSYYFRVLASNEYGIGLPAETTEPVKVSEPPLPPGRVTLVDVTRNTATIKWEKPESDGGSKITGYVVEMQTKGSEKWSTCTQVKTLEATISGLTAGEEYVFRVAAVNEKGRSDPRQLGVPVIARDIEIKPSVELPFHTFNVKAREQLKIDVPFKGRPQATVNWRKDGQTLKETTRVNVSSSKTVTSLSIKEASKEDVGTYELCVSNSAGSITVPITIIVLDRPGPPGPIRIDEVSCDSITISWNPPEYDGGCQISNYIVEKKETTSTTWHIVSQAVARTSIKIVRLTTGSEYQFRVCAENRYGKSSYSESSAVVAEYPFSPPGPPGTPKVVHATKSTMLVTWQVPVNDGGSRVIGYHLEYKERSSILWSKANKILIADTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRYEFRVFARNAADSVSEPSESTGPIIVKDDVEPPRVMMDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNSLRWVRVNKKPVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTKESAVLSWDVPENDGGAPVKNYHIEKREASKKAWVSVTNNCNRLSYKVTNLQEGAIYYFRVSGENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSILWQKANKLVIRTTHFKVTTISAGLIYEFRVYAENAAGVGKPSHPSEPVLAIDACEPPRNVRITDISKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDARYSIENTDSSSLLTIPQVTRNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKDGGGTEITNYIVEKRESGTTAWQLVNSSVKRTQIKVTHLTKYMEYSFRVSSENRFGVSKPLESAPIIAEHPFVPPSAPTRPEVYHVSANAMSIRWEEPYHDGGSKIIGYWVEKKERNTILWVKENKVPCLECNYKVTGLVEGLEYQFRTYALNAAGVSKASEASRPIMAQNPVDAPGRPEVTDVTRSTVSLIWSAPAYDGGSKVVGYIIERKPVSEVGDGRWLKCNYTIVSDNFFTVTALSEGDTYEFRVLAKNAAGVISKGSESTGPVTCRDEYAPPKAELDARLHGDLVTIRAGSDLVLDAAVGGKPEPKIIWTKGDKELDLCEKVSLQYTGKRATAVIKFCDRSDSGKYTLTVKNASGTKAVSVMVKVLDSPGPCGKLTVSRVTQEKCTLAWSLPQEDGGAEITHYIVERRETSRLNWVIVEGECPTLSYVVTRLIKNNEYIFRVRAVNKYGPGVPVESEPIVARNSFTIPSPPGIPEEVGTGKEHIIIQWTKPESDGGNEISNYLVDKREKKSLRWTRVNKDYVVYDTRLKVTSLMEGCDYQFRVTAVNAAGNSEPSEASNFISCREPSYTPGPPSAPRVVDTTKHSISLAWTKPMYDGGTDIVGYVLEMQEKDTDQWYRVHTNATIRNTEFTVPDLKMGQKYSFRVAAVNVKGMSEYSESIAEIEPVERIEIPDLELADDLKKTVTIRAGASLRLMVSVSGRPPPVITWSKQGIDLASRAIIDTTESYSLLIVDKVNRYDAGKYTIEAENQSGKKSATVLVKVYDTPGPCPSVKVKEVSRDSVTITWEIPTIDGGAPVNNYIVEKREAAMRAFKTVTTKCSKTLYRISGLVEGTMYYFRVLPENIYGIGEPCETSDAVLVSEVPLVPAKLEVVDVTKSTVTLAWEKPLYDGGSRLTGYVLEACKAGTERWMKVVTLKPTVLEHTVTSLNEGEQYLFRIRAQNEKGVSEPRETVTAVTVQDLRVLPTIDLSTMPQKTIHVPAGRPVELVIPIAGRPPPAASWFFAGSKLRESERVTVETHTKVAKLTIRETTIRDTGEYTLELKNVTGTTSETIKVIILDKPGPPTGPIKIDEIDATSITISWEPPELDGGAPLSGYVVEQRDAHRPGWLPVSESVTRSTFKFTRLTEGNEYVFRVAATNRFGIGSYLQSEVIECRSSIRIPGPPETLQIFDVSRDGMTLTWYPPEDDGGSQVTGYIVERKEVRADRWVRVNKVPVTMTRYRSTGLTEGLEYEHRVTAINARGSGKPSRPSKPIVAMDPIAPPGKPQNPRVTDTTRTSVSLAWSVPEDEGGSKVTGYLIEMQKVDQHEWTKCNTTPTKIREYTLTHLPQGAEYRFRVLACNAGGPGEPAEVPGTVKVTEMLEYPDYELDERYQEGIFVRQGGVIRLTIPIKGKPFPICKWTKEGQDISKRAMIATSETHTELVIKEADRGDSGTYDLVLENKCGKKAVYIKVRVIGSPNSPEGPLEYDDIQVRSVRVSWRPPADDGGADILGYILERREVPKAAWYTIDSRVRGTSLVVKGLKENVEYHFRVSAENQFGISKPLKSEEPVTPKTPLNPPEPPSNPPEVLDVTKSSVSLSWSRPKDDGGSRVTGYYIERKETSTDKWVRHNKTQITTTMYTVTGLVPDAEYQFRIIAQNDVGLSETSPASEPVVCKDPFDKPSQPGELEILSISKDSVTLQWEKPECDGGKEILGYWVEYRQSGDSAWKKSNKERIKDKQFTIGGLLEATEYEFRVFAENETGLSRPRRTAMSIKTKLTSGEAPGIRKEMKDVTTKLGEAAQLSCQIVGRPLPDIKWYRFGKELIQSRKYKMSSDGRTHTLTVMTEEQEDEGVYTCIATNEVGEVETSSKLLLQATPQFHPGYPLKEKYYGAVGSTLRLHVMYIGRPVPAMTWFHGQKLLQNSENITIENTEHYTHLVMKNVQRKTHAGKYKVQLSNVFGTVDAILDVEIQDKPDKPTGPIVIEALLKNSAVISWKPPADDGGSWITNYVVEKCEAKEGAEWQLVSSAISVTTCRIVNLTENAGYYFRVSAQNTFGISDPLEVSSVVIIKSPFEKPGAPGKPTITAVTKDSCVVAWKPPASDGGAKIRNYYLEKREKKQNKWISVTTEEIRETVFSVKNLIEGLEYEFRVKCENLGGESEWSEISEPITPKSDVPIQAPHFKEELRNLNVRYQSNATLVCKVTGHPKPIVKWYRQGKEIIADGLKYRIQEFKGGYHQLIIASVTDDDATVYQVRATNQGGSVSGTASLEVEVPAKIHLPKTLEGMGAVHALRGEVVSIKIPFSGKPDPVITWQKGQDLIDNNGHYQVIVTRSFTSLVFPNGVERKDAGFYVVCAKNRFGIDQKTVELDVADVPDPPRGVKVSDVSRDSVNLTWTEPASDGGSKITNYIVEKCATTAERWLRVGQARETRYTVINLFGKTSYQFRVIAENKFGLSKPSEPSEPTITKEDKTRAMNYDEEVDETREVSMTKASHSSTKELYEKYMIAEDLGRGEFGIVHRCVETSSKKTYMAKFVKVKGTDQVLVKKEISILNIARHRNILHLHESFESMEELVMIFEFISGLDIFERINTSAFELNEREIVSYVHQVCEALQFLHSHNIGHFDIRPENIIYQTRRSSTIKIIEFGQARQLKPGDNFRLLFTAPEYYAPEVHQHDVVSTATDMWSLGTLVYVLLSGINPFLAETNQQIIENIMNAEYTFDEEAFKEISIEAMDFVDRLLVKERKSRMTASEALQHPWLKQKIERVSTKVIRTLKHRRYYHTLIKKDLNMVVSAARISCGGAIRSQKGVSVAKVKVASIEIGPVSGQIMHAVGEEGGHVKYVCKIENYDQSTQVTWYFGVRQLENSEKYEITYEDGVAILYVKDITKLDDGTYRCKVVNDYGEDSSYAELFVKGVREVYDYYCRRTMKKIKRRTDTMRLLERPPEFTLPLYNKTAYVGENVRFGVTITVHPEPHVTWYKSGQKIKPGDNDKKYTFESDKGLYQLTINSVTTDDDAEYTVVARNKYGEDSCKAKLTVTLHPPPTDSTLRPMFKRLLANAECQEGQSVCFEIRVSGIPPPTLKWEKDGQPLSLGPNIEIIHEGLDYYALHIRDTLPEDTGYYRVTATNTAGSTSCQAHLQVERLRYKKQEFKSKEEHERHVQKQIDKTLRMAEILSGTESVPLTQVAKEALREAAVLYKPAVSTKTVKGEFRLEIEEKKEERKLRMPYDVPEPRKYKQTTIEEDQRIKQFVPMSDMKWYKKIRDQYEMPGKLDRVVQKRPKRIRLSRWEQFYVMPLPRITDQYRPKWRIPKLSQDDLEIVRPARRRTPSPDYDFYYRPRRRSLGDISDEELLLPIDDYLAMKRTEEERLRLEEELELGFSASPPSRSPPHFELSSLRYSSPQAHVKVEETRKDFRYSTYHIPTKAEASTSYAELRERHAQAAYRQPKQRQRIMAEREDEELLRPVTTTQHLSEYKSELDFMSKEEKSRKKSRRQREVTEITEIEEEYEISKHAQRESSSSASRLLRRRRSLSPTYIELMRPVSELIRSRPQPAEEYEDDTERRSPTPERTRPRSPSPVSSERSLSRFERSARFDIFSRYESMKAALKTQKTSERKYEVLSQQPFTLDHAPRITLRMRSHRVPCGQNTRFILNVQSKPTAEVKWYHNGVELQESSKIHYTNTSGVLTLEILDCHTDDSGTYRAVCTNYKGEASDYATLDVTGGDYTTYASQRRDEEVPRSVFPELTRTEAYAVSSFKKTSEMEASSSVREVKSQMTETRESLSSYEHSASAEMKSAALEEKSLEEKSTTRKIKTTLAARILTKPRSMTVYEGESARFSCDTDGEPVPTVTWLRKGQVLSTSARHQVTTTKYKSTFEISSVQASDEGNYSVVVENSEGKQEAEFTLTIQKARVTEKAVTSPPRVKSPEPRVKSPEAVKSPKRVKSPEPSHPKAVSPTETKPTPTEKVQHLPVSAPPKITQFLKAEASKEIAKLTCVVESSVLRAKEVTWYKDGKKLKENGHFQFHYSADGTYELKINNLTESDQGEYVCEISGEGGTSKTNLQFMGQAFKSIHEKVSKISETKKSDQKTTESTVTRKTEPKAPEPISSKPVIVTGLQDTTVSSDSVAKFAVKATGEPRPTAIWTKDGKAITQGGKYKLSEDKGGFFLEIHKTDTSDSGLYTCTVKNSAGSVSSSCKLTIKAIKDTEAQKVSTQKTSEITPQKKAVVQEEISQKALRSEEIKMSEAKSQEKLALKEEASKVLISEEVKKSAATSLEKSIVHEEITKTSQASEEVRTHAEIKAFSTQMSINEGQRLVLKANIAGATDVKWVLNGVELTNSEEYRYGVSGSDQTLTIKQASHRDEGILTCISKTKEGIVKCQYDLTLSKELSDAPAFISQPRSQNINEGQNVLFTCEISGEPSPEIEWFKNNLPISISSNVSISRSRNVYSLEIRNASVSDSGKYTIKAKNFRGQCSATASLMVLPLVEEPSREVVLRTSGDTSLQGSFSSQSVQMSASKQEASFSSFSSSSASSMTEMKFASMSAQSMSSMQESFVEMSSSSFMGISNMTQLESSTSKMLKAGIRGIPPKIEALPSDISIDEGKVLTVACAFTGEPTPEVTWSCGGRKIHSQEQGRFHIENTDDLTTLIIMDVQKQDGGLYTLSLGNEFGSDSATVNIHIRSI

SEQ ID NO: 3310 - protein, 5604 aa, Homo sapiens
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIRQETEITAASMVVVATAKSTKLETVPGAQEETTTQQDQMHLSYEKIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDLRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENITSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEAPESILHERIEQEIEMEMKELFSEGESEHSERDTRDAFSDSEDIDHKSMAAKRYASRISSTSSWPEYFKPSFTQKLTFKYVLEGEPVVFTCRLIACPTPEMTWFHNNRPIPTGLRRIIKAESDLHHHSSSLEIKRVQDRDSGSYRLLAINSEGSAESTASLLVIQKGQDEKYLEFLKRAERTHENVEALVERGEDRIKVDLRFTGSPFNKKQDVEQKGMMRTIHFKTMSSAKKTDYMYDEEYLESKSDIRGWLNVGESFLDKETKVKLQRLREARKTLMEKKKLSLLDTSSEISSRTFRSEASDKDILFSREDMKIRSMSDLAESYKVDHSAESIVQNPHALSNQMDQNIESEELPTSFQTIVDEEIFQTEIRMSQEALVKESLPKDHLYGEILVNENTQARGQLEEIMANTTIGESSTYITNVCEKEEVYETPENVSQAITPHASESFGTLVNVEESEEIASERIKKDDLRELQLSASTRIDEFKTEQKEENMRFFENSFRKRPQRCPPSFLQEIESQEVYEGDSCNFVCHFQGYPQPIVTWYNNDMPIPRNQNFIIHSLENYSILTLSSVHHQNEGSITCVLFNQYGTVKTTSMLKVKAKQKHDVKAHKVPVFHDYLDEEEELALVFDQAKGAHPSMSQEGQTNLHLLKTNPPVPPSGDTELLSFPVEIQVTAATPIPEQDKESKEVFQTEELEPKAMPQDQVTQSPKHRFVFLSDITNEPPKMLQEMPKHARCREGDSIILECLISGEPQPVVTWFQNGVLLKQNQKFQFEEVNCSHQLYIKDVNSQDSGKYKCVAENNSGAVESVSDLTVEPVTYRENSQFENIGEIYGKYSRDQQLQDQGESVRAHFYDYPAGPFTPWTNVKEYSVRDYFQSLETIEQIDQKEQVRCIPSREKIPRFVHGASRTIKISKPIRAEFIQCQAEGKERHVSEKSKLHQAEGTVYPFVDDFSDVTIKKEIRNNFGKLGRSEKENVQECAQSDYLPNIHSERISDSYNTKDSSAIVYEESLGEEIHYPGKKVKHRIIEFEKLHVEKGVLEKRPTRTSIVNPPQKKIDDKAFSLKQRESRSSNLNANMYQAEKMSPNTESDSSNIAINLKLLSSQTHKEFDAQEREQQEKISLIDKPAISKRAEHESPITFDLKQFHTQIKHTDVKFQELDSGQPEEAYFKIQHPADTENIVFDLKQMYSHIGDPALEFQGQETREQQEIHYKEKIPSPETLQPDTHNISKSVQNNVFASQEISSSQELSNRTMVEKSSIDENSISLEKEVRHVQEQNLDILKTDLSLKSFSEEIYSESCALLPTSSADIEETDLSEKSCPLENGGRSSISHLKKAASEEKPLGVGEMEEECTLEPELAAFPKQDGGTQEYTDATLEDHRGDVQEADTLHRQLSLSQCFPLLMTEEQQNPGEQISTNIHASGEEKCYEEVQVQNEASFSTLEGEMIETSFSQNIPKLDEAHTTEAAESETSLTQYLLAAGKREVPETKDTRDQAKLVQSESITSMEVEEVTFNTVYEYYNQKQESLGRPLSPESDISIGVGSTTSEEISELDQFYTPPSSVEYFESPKSPDLYFNPSDITKQSSIHSGGETVERYSTPLGEVAERYSTPSEGEVGERYSTPPGETLERYSTPPGETLERYSTPPGETLERYSTPPGETLERYSTPPGETLERYSTPPGEALERYSIPTGGPNPTGTFKTYPSKIEMEDGTPNEHFYTPTEERGSAYEIWRSDSFGTPNEAIEPKDNEMPPSFIEPLTKRKVYENTTLGFIVEVEGLPVPGVKWYRNKSLLEPDERIKMERVGNVCSLEISNIQKGEGGEYMCHAVNIIGEAKSFANVDIMPQEERVVALPPPVTHQHVMEFDLEHTTSSRTPSPQEIVLEVELSEKDVKEFEKQVKIVTVPEFTPDHKSMIVSLDVLPFNFVDPNMDSREGEDKELKIDLEVFEMPPRFIMPICDFKIPENSDAVFKCSVIGIPTPEVKWYKEYMCIEPDNIKYVISEEKGSHTLKIRNVCLSDSATYRCRAVNCVGEAICRGFLTMGDSEIFAVIAKKSKVTLSSLMEELVLKSNYTDSFFEFQVVEGPPRFIKGISDCYAPIGTAAYFQCLVRGSPRPTVYWYKDGKLVQGRRFTVEESGTGFHNLFITSLVKSDEGEYRCVATNKSGMAESFAALTLT

SEQ ID NO: 3311 - protein, 27051 aa, Homo sapiens
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDLRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENITSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEGFSKFEENTSNSQWHVSLSVSFKKEPLGQKPSFIQPLSSLRVHNGETVRFHARVSGIPKPEIQWFHNQQLILPTKDVVFHFEESTGMALMLIVDAYSEHAGQYSCKAANSAGEATCAATLTVTPKAPESILHERIEQEIEMEMKEFSSSFLSAEEEGLHSAELQLSKINETLELLSESPVYSTKFDSEKEGTGPIFIKEVSNADISMGDVATLSVTVIGIPKPKIQWFFNGVLLTPSADYKFVFDGDDHSLIILFTKLEDEGEYTCMASNDYGKTICSAYLKINSKGEGHKDTETESAVAKSLEKLGGPCPPHFLKELKPIRCAQGLPAIFEYTVVGEPAPTVTWFKENKQLCTSVYYTIIHNPNGSGTFIVNDPQREDSGLYICKAENMLGESTCAAELLVLLEDTDMTDTPCKAKSTPEAPEDFPQTPLKGPAVEALDSEQEIATFVKDTILKAALITEENQQLSYEHIAKANELSSQLPLGAQELQSILEQDKLTPESTREFLCINGSIHFQPLKEPSPNLQLQIVQSQKTFSKEGILMPEEPETQAVLSDTEKIFPSAMSIEQINSLTVEPLKTLLAEPEGNYPQSSIEPPMHSYLTSVAEEVLSPKEKTVSDTNREQRVTLQKQEAQSALILSQSLAEGHVESLQSPDVMISQVNYEPLVPSEHSCTEGGKILIESANPLENAGQDSAVRIEEGKSLRFPLALEEKQVLLKEEHSDNVVMPPDQIIESKREPVAIKKVQEVQGRDLLSKESLLSGIPEEQRLNLKIQICRALQAAVASEQPGLFSEWLRNIEKVEVEAVNITQEPRHIMCMYLVTSAKSVTEEVTIIIEDVDPQMANLKMELRDALCAIIYEEIDILTAEGPRIQQGAKTSLQEEMDSFSGSQKVEPITEPEVESKYLISTEEVSYFNVQSRVKYLDATPVTKGVASAVVSDEKQDESLKPSEEKEESSSESGTEEVATVKIQEAEGGLIKEDGPMIHTPLVDTVSEEGDIVHLTTSITNAKEVNWYFENKLVPSDEKFKCLQDQNTYTLVIDKVNTEDHQGEYVCEALNDSGKTATSAKLTVVKRAAPVIKRKIEPLEVALGHLAKFTCEIQSAPNVRFQWFKAGREIYESDKCSIRSSKYISSLEILRTQVVDCGEYTCKASNEYGSVSCTATLTVTVPGGEKKVRKLLPERKPEPKEEVVLKSVLRKRPEEEEPKVEPKKLEKVKKPAVPEPPPPKPVEEVEVPTVTKRERKIPEPTKVPEIKPAIPLPAPEPKPKPEAEVKTIKPPPVEPEPTPIAAPVTVPVVGKKAEAKAPKEEAAKPKGPIKGVPKKTPSPIEAERRKLRPGSGGEKPPDEAPFTYQLKAVPLKFVKEIKDIILTESEFVGSSAIFECLVSPSTAITTWMKDGSNIRESPKHRFIADGKDRKLHIIDVQLSDAGEYTCVLRLGNKEKTSTAKLVVEELPVRFVKTLEEEVTVVKGQPLYLSCELNKERDVVWRKDGKIVVEKPGRIVPGVIGLMRALTINDADDTDAGTYTVTVENANNLECSSCVKVVEVIRDWLVKPIRDQHVKPKGTAIFACDIAKDTPNIKWFKGYDEIPAEPNDKTEILRDGNHLYLKIKNAMPEDIAEYAVEIEGKRYPAKLTLGEREVELLKPIEDVTIYEKESASFDAEISEADIPGQWKLKGELLRPSPTCEIKAEGGKRFLTLHKVKLDQAGEVLYQALNAITTAILTVKEIELDFAVPLKDVTVPERRQARFECVLTREANVIWSKGPDIIKSSDKFDIIADGKKHILVINDSQFDDEGVYTAEVEGKKTSARLFVTGIRLKFMSPLEDQTVKEGETATFVCELSHEKMHVVWFKNDAKLHTSRTVLISSEGKTHKLEMKEVTLDDISQIKAQVKELSSTAQLKVLEADPYFTVKLHDKTAVEKDEITLKCEVSKDVPVKWFKDGEEIVPSPKYSIKADGLRRILKIKKADLKDKGEYVCDCGTDKTKANVTVEARLIKVEKPLYGVEVFVGETAHFEIELSEPDVHGQWKLKGQPLTASPDCEIIEDGKKHILILHNCQLGMTGEVSFQAANAKSAANLKVKELPLIFITPLSDVKVFEKDEAKFECEVSREPKTFRWLKGTQEITGDDRFELIKDGTKHSMVIKSAAFEDEAKYMFEAEDKHTSGKLIIEGIRLKFLTPLKDVTAKEKESAVFTVELSHDNIRVKWFKNDQRLHTTRSVSMQDEGKTHSITFKDLSIDDTSQIRVEAMGMSSEAKLTVLEGDPYFTGKLQDYTGVEKDEVILQCEISKADAPVKWFKDGKEIKPSKNAVIKADGKKRMLILKKALKSDIGQYTCDCGTDKTSGKLDIEDREIKLVRPLHSVEVMETETARFETEISEDDIHANWKLKGEALLQTPDCEIKEEGKIHSLVLHNCRLDQTGGVDFQAANVKSSAHLRVKPRVIGLLRPLKDVTVTAGETATFDCELSYEDIPVEWYLKGKKLEPSDKVVPRSEGKVHTLTLRDVKLEDAGEVQLTAKDFKTHANLFVKEPPVEFTKPLEDQTVEEGATAVLECEVSRENAKVKWFKNGTEILKSKKYEIVADGRVRKLVIHDCTPEDIKTYTCDAKDFKTSCNLNVVPPHVEFLRPLTDLQVREKEMARFECELSRENAKVKWFKDGAEIKKGKKYDIISKGAVRILVINKCLLDDEAEYSCEVRTARTSGMLTVLEEEAVFTKNLANIEVSETDTIKLVCEVSKPGAEVIWYKGDEEIIETGRYEILTEGRKRILVIQNAHLEDAGNYNCRLPSSRTDGKVKVHELAAEFISKPQNLEILEGEKAEFVCSISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPLKDIETMEKKSVTFWCKVNRLNVTLKWTKNGEEVPFDNRVSYRVDKYKHMLTIKDCGFPDEGEYIVTAGQDKSVAELLIIEAPTEFVEHLEDQTVTEFDDAVFSCQLSREKANVKWYRNGREIKEGKKYKFEKDGSIHRLIIKDCRLDDECEYACGVEDRKSRARLFVEEIPVEIIRPPQDILEAPGADVVFLAELNKDKVEVQWLRNNMVVVQGDKHQMMSEGKIHRLQICDIKPRDQGEYRFIAKDKEARAKLELAAAPKIKTADQDLVVDVGKPLTMVVPYDAYPKAEAEWFKENEPLSTKTIDTTAEQTSFRILEAKKGDKGRYKIVLQNKHGKAEGFINLKVIDVPGPVRNLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFVEPTMDLSAFKDGLEVIVPNPITILVPSTGYPRPTATWCFGDKVLETGDRVKMKTLSAYAELVISPSERSDKGIYTLKLENRVKTISGEIDVNVIARPSAPKELKFGDITKDSVHLTWEPPDDDGGSPLTGYVVEKREVSRKTWTKVMDFVTDLEFTVPDLVQGKEYLFKVCARNKCGPGEPAYVDEPVNMSTPATVPDPPENVKWRDRTANSIFLTWDPPKNDGGSRIKGYIVERCPRGSDKWVACGEPVAETKMEVTGLEEGKWYAYRVKALNRQGASKPSRPTEEIQAVDTQEAPEIFLDVKLLAGLTVKAGTKIELPATVTGKPEPKITWTKADMILKQDKRITIENVPKKSTVTIVDSKRSDTGTYIIEAVNVCGRATAVVEVNVLDKPGPPAAFDITDVTNESCLLTWNPPRDDGGSKITNYVVERRATDSEVWHKLSSTVKDTNFKATKLIPNKEYIFRVAAENMYGVGEPVQASPITAKYQFDPPGPPTRLEPSDITKDAVTLTWCEPDDDGGSPITGYWVERLDPDTDKWVRCNKMPVKDTTYRVKGLTNKKKYRFRVLAENLAGPGKPSKSTEPILIKDPIDPPWPPGKPTVKDVGKTSVRLNWTKPEHDGGAKIESYVIEMLKTGTDEWVRVAEGVPTTQHLLPGLMEGQEYSFRVRAVNKAGESEPSEPSDPVLCREKLYPPSPPRWLEVINITKNTADLKWTVPEKDGGSPITNYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWVKAGKTAGPDCNFRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKPTIDLETHDIIVIEGEKLSIPVPFRAVPVPTVSWHKDGKEVKASDRLTMKNDHISAHLEVPKSVRADAGIYTITLENKLGSATASINVKVIGLPGPCKDIKASDITKSSCKLTWEPPEFDGGTPILHYVLERREAGRRTYIPVMSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRATPPTKAVDPIDAPKVILRTSLEVKRGDEIALDASISGSPYPTITWIKDENVIVPEEIKKRAAPLVRRRKGEVQEEEPFVLPLTQRLSIDNSKKGESQLRVRDSLRPDHGLYMIKVENDHGIAKAPCTVSVLDTPGPPINFVFEDIRKTSVLCKWEPPLDDGGSEIINYTLEKKDKTKPDSEWIVVTSTLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPISPPGPPIPRVTDTSSTTIELEWEPPAFNGGGEIVGYFVDKQLVGTNEWSRCTEKMIKVRQYTVKEIREGADYKLRVSAVNAAGEGPPGETQPVTVAEPQEPPAVELDVSVKGGIQIMAGKTLRIPAVVTGRPVPTKVWTKEEGELDKDRVVIDNVGTKSELIIKDALRKDHGRYVITATNSCGSKFAAARVEVFDVPGPVLDLKPVVTNRKMCLLNWSDPEDDGGSEITGFIIERKDAKMHTWRQPIETERSKCDITGLLEGQEYKFRVIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKGTYTVTASNRLGSVFRNVHVEVYDRPSPPRNLAVTDIKAESCYLTWDAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKIGLITKNTVHLSWKPPKNDGGSPVTHYIVECLAWDPTGTKKEAWRQCNKRDVEELQFTVEDLVEGGEYEFRVKAVNAAGVSKPSATVGPCDCQRPDMPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFRVSAVNIAGIGEPGEVTDVIEMKDRLVSPDLQLDASVRDRIVVHAGGVIRIIAYVSGKPPPTVTWNMNERTLPQEATIETTAISSSMVIKNCQRSHQGVYSLLAKNEAGERKKTIIVDVLDVPGPVGTPFLAHNLTNESCKLTWFSPEDDGGSPITNYVIEKRESDRRAWTPVTYTVTRQNATVQGLIQGKAYFFRIAAENSIGMGPFVETSEALVIREPITVPERPEDLEVKEVTKNTVTLTWNPPKYDGGSEIINYVLESRLIGTEKFHKVTNDNLLSRKYTVKGLKEGDTYEYRVSAVNIVGQGKPSFCTKPITCKDELAPPTLHLDFRDKLTIRVGEAFALTGRYSGKPKPKVSWFKDEADVLEDDRTHIKTTPATLALEKIKAKRSDSGKYCVVVENSTGSRKGFCQVNVVDRPGPPVGPVSFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFPKVTWKKEDRDAPTKARIDVTPVGSKLEIRNAAHEDGGIYSLTVENPAGSKTVSVKVLVLDKPGPPRDLEVSEIRKDSCYLTWKEPLDDGGSVITNYVVERRDVASAQWSPLSATSKKKSHFAKHLNEGNQYLFRVAAENQYGRGPFVETPKPIKALDPLHPPGPPKDLHHVDVDKTEVSLVWNKPDRDGGSPITGYLVEYQEEGTQDWIKFKTVTNLECVVTGLQQGKTYRFRVKAENIVGLGLPDTTIPIECQEKLVPPSVELDVKLIEGLVVKAGTTVRFPAIIRGVPVPTAKWTTDGSEIKTDEHYTVETDNFSSVLTIKNCLRRDTGEYQITVSNAAGSKTVAVHLTVLDVPGPPTGPINILDVTPEHMTISWQPPKDDGGSPVINYIVEKQDTRKDTWGVVSSGSSKTKLKIPHLQKGCEYVFRVRAENKIGVGPPLDSTPTVAKHKFSPPSPPGKPVVTDITENAATVSWTLPKSDGGSPITGYYMERREVTGKWVRVNKTPIADLKFRVTGLYEGNTYEFRVFAENLAGLSKPSPSSDPIKACRPIKPPGPPINPKLKDKSRETADLVWTKPLSDGGSPILGYVVECQKPGTAQWNRINKDELIRQCAFRVPGLIEGNEYRFRIKAANIVGEGEPRELAESVIAKDILHPPEVELDVTCRDVITVRVGQTIRILARVKGRPEPDITWTKEGKVLVREKRVDLIQDLPRVELQIKEAVRADHGKYIISAKNSSGHAQGSAIVNVLDRPGPCQNLKVTNVTKENCTISWENPLDNGGSEITNFIVEYRKPNQKGWSIVASDVTKRLIKANLLANNEYYFRVCAENKVGVGPTIETKTPILAINPIDRPGEPENLHIADKGKTFVYLKWRRPDYDGGSPNLSYHVERRLKGSDDWERVHKGSIKETHYMVDRCVENQIYEFRVQTKNEGGESDWVKTEEVVVKEDLQKPVLDLKLSGVLTVKAGDTIRLEAGVRGKPFPEVAWTKDKDATDLTRSPRVKIDTRADSSKFSLTKAKRSDGGKYVVTATNTAGSFVAYATVNVLDKPGPVRNLKIVDVSSDRCTVCWDPPEDDGGCEIQNYILEKCETKRMVWSTYSATVLTPGTTVTRLIEGNEYIFRVRAENKIGTGPPTESKPVIAKTKYDKPGRPDPPEVTKVSKEEMTVVWNPPEYDGGKSITGYFLEKKEKHSTRWVPVNKSAIPERRMKVQNLLPDHEYQFRVKAENEIGIGEPSLPSRPVVAKDPIEPPGPPTNFRVVDTTKHSITLGWGKPVYDGGAPIIGYVVEMRPKIADASPDEGWKRCNAAAQLVRKEFTVTSLDENQEYEFRVCAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVNPAGEKAVFVNVRVLDTPGPVSDLKVSDVTKTSCHVSWAPPENDGGSQVTHYIVEKREADRKTWSTVTPEVKKTSFHVTNLVPGNEYYFRVTAVNEYGPGVPTDVPKPVLASDPLSEPDPPRKLEVTEMTKNSATLAWLPPLRDGGAKIDGYITSYREEEQPADRWTEYSVVKDLSLVVTGLKEGKKYKFRVAARNAVGVSLPREAEGVYEAKEQLLPPKILMPEQITIKAGKKLRIEAHVYGKPHPTCKWKKGEDEVVTSSHLAVHKADSSSILIIKDVTRKDSGYYSLTAENSSGTDTQKIKVVVMDAPGPPQPPFDISDIDADACSLSWHIPLEDGGSNITNYIVEKCDVSRGDWVTALASVTKTSCRVGKLIPGQEYIFRVRAENRFGISEPLTSPKMVAQFPFGVPSEPKNARVTKVNKDCIFVAWDRPDSDGGSPIIGYLIERKERNSLLWVKANDTLVRSTEYPCAGLVEGLEYSFRIYALNKAGSSPPSKPTEYVTARMPVDPPGKPEVIDVTKSTVSLIWARPKHDGGSKIIGYFVEACKLPGDKWVRCNTAPHQIPQEEYTATGLEEKAQYQFRAIARTAVNISPPSEPSDPVTILAENVPPRIDLSVAMKSLLTVKAGTNVCLDATVFGKPMPTVSWKKDGTLLKPAEGIKMAMQRNLCTLELFSVNRKDSGDYTITAENSSGSKSATIKLKVLDKPGPPASVKINKMYSDRAMLSWEPPLEDGGSEITNYIVDKRETSRPNWAQVSATVPITSCSVEKLIEGHEYQFRICAENKYGVGDPVFTEPAIAKNPYDPPGRCDPPVISNITKDHMTVSWKPPADDGGSPITGYLLEKRETQAVNWTKVNRKPIIERTLKATGLQEGTEYEFRVTAINKAGPGKPSDASKAAYARDPQYPPAPPAFPKVYDTTRSSVSLSWGKPAYDGGSPIIGYLVEVKRADSDNWVRCNLPQNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVLDTPGPPVNVTVKEISKDSAYVTWEPPIIDGGSPIINYVVQKRDAERKSWSTVTTECSKTSFRVANLEEGKSYFFRVFAENEYGIGDPGETRDAVKASQTPGPVVDLKVRSVSKSSCSIGWKKPHSDGGSRIIGYVVDFLTEENKWQRVMKSLSLQYSAKDLTEGKEYTFRVSAENENGEGTPSEITVVARDDVVAPDLDLKGLPDLCYLAKENSNFRLKIPIKGKPAPSVSWKKGEDPLATDTRVSVESSAVNTTLIVYDCQKSDAGKYTITLKNVAGTKEGTISIKVVGKPGIPTGPIKFDEVTAEAMTLKWAPPKDDGGSEITNYILEKRDSVNNKWVTCASAVQKTTFRVTRLHEGMEYTFRVSAENKYGVGEGLKSEPIVARHPFDVPDAPPPPNIVDVRHDSVSLTWTDPKKTGGSPITGYHLEFKERNSLLWKRANKTPIRMRDFKVTGLTEGLEYEFRVMAINLAGVGKPSLPSEPVVALDPIDPPGKPEVINITRNSVTLIWTEPKYDGGHKLTGYIVEKRDLPSKSWMKANHVNVPECAFTVTDLVEGGKYEFRIRAKNTAGAISAPSESTETIICKDEYEAPTIVLDPTIKDGLTIKAGDTIVLNAISILGKPLPKSSWSKAGKDIRPSDITQITSTPTSSMLTIKYATRKDAGEYTITATNPFGTKVEHVKVTVLDVPGPPGPVEISNVSAEKATLTWTPPLEDGGSPIKSYILEKRETSRLLWTVVSEDIQSCRHVATKLIQGNEYIFRVSAVNHYGKGEPVQSEPVKMVDRFGPPGPPEKPEVSNVTKNTATVSWKRPVDDGGSEITGYHVERREKKSLRWVRAIKTPVSDLRCKVTGLQEGSTYEFRVSAENRAGIGPPSEASDSVLMKDAAYPPGPPSNPHVTDTTKKSASLAWGKPHYDGGLEITGYVVEHQKVGDEAWIKDTTGTALRITQFVVPDLQTKEKYNFRISAINDAGVGEPAVIPDVEIVEREMAPDFELDAELRRTLVVRAGLSIRIFVPIKGRPAPEVTWTKDNINLKNRANIENTESFTLLIIPECNRYDTGKFVMTIENPAGKKSGFVNVRVLDTPGPVLNLRPTDITKDSVTLHWDLPLIDGGSRITNYIVEKREATRKSYSTATTKCHKCTYKVTGLSEGCEYFFRVMAENEYGIGEPTETTEPVKASEAPSPPDSLNIMDITKSTVSLAWPKPKHDGGSKITGYVIEAQRKGSDQWTHITTVKGLECVVRNLTEGEEYTFQVMAVNSAGRSAPRESRPVIVKEQTMLPELDLRGIYQKLVIAKAGDNIKVEIPVLGRPKPTVTWKKGDQILKQTQRVNFETTATSTILNINECVRSDSGPYPLTARNIVGEVGDVITIQVHDIPGPPTGPIKFDEVSSDFVTFSWDPPENDGGVPISNYVVEMRQTDSTTWVELATTVIRTTYKATRLTTGLEYQFRVKAQNRYGVGPGITSACIVANYPFKVPGPPGTPQVTAVTKDSMTISWHEPLSDGGSPILGYHVERKERNGILWQTVSKALVPGNIFKSSGLTDGIAYEFRVIAENMAGKSKPSKPSEPMLALDPIDPPGKPVPLNITRHTVTLKWAKPEYTGGFKITSYIVEKRDLPNGRWLKANFSNILENEFTVSGLTEDAAYEFRVIAKNAAGAISPPSEPSDAITCRDDVEAPKIKVDVKFKDTVILKAGEAFRLEADVSGRPPPTMEWSKDGKELEGTAKLEIKIADFSTNLVNKDSTRRDSGAYTLTATNPGGFAKHIFNVKVLDRPGPPEGPLAVTEVTSEKCVLSWFPPLDDGGAKIDHYIVQKRETSRLAWTNVASEVQVTKLKVTKLLKGNEYIFRVMAVNKYGVGEPLESEPVLAVNPYGPPDPPKNPEVTTITKDSMVVCWGHPDSDGGSEIINYIVERRDKAGQRWIKCNKKTLTDLRYKVSGLTEGHEYEFRIMAENAAGISAPSPTSPFYKACDTVFKPGPPGNPRVLDTSRSSISIAWNKPIYDGGSEITGYMVEIALPEEDEWQIVTPPAGLKATSYTITGLTENQEYKIRIYAMNSEGLGEPALVPGTPKAEDRMLPPEIELDADLRKVVTIRACCTLRLFVPIKGRPAPEVKWARDHGESLDKASIESTSSYTLLIVGNVNRFDSGKYILTVENSSGSKSAFVNVRVLDTPGPPQDLKVKEVTKTSVTLTWDPPLLDGGSKIKNYIVEKRESTRKAYSTVATNCHKTSWKVDQLQEGCSYYFRVLAENEYGIGLPAETAESVKASERPLPPGKITLMDVTRNSVSLSWEKPEHDGGSRILGYIVEMQTKGSDKWATCATVKVTEATITGLIQGEEYSFRVSAQNEKGISDPRQLSVPVIAKDLVIPPAFKLLFNTFTVLAGEDLKVDVPFIGRPTPAVTWHKDNVPLKQTTRVNAESTENNSLLTIKDACREDVGHYVVKLTNSAGEAIETLNVIVLDKPGPPTGPVKMDEVTADSITLSWGPPKYDGGSSINNYIVEKRDTSTTTWQIVSATVARTTIKACRLKTGCEYQFRIAAENRYGKSTYLNSEPTVAQYPFKVPGPPGTPVVTLSSRDSMEVQWNEPISDGGSRVIGYHLERKERNSILWVKLNKTPIPQTKFKTTGLEEGVEYEFRVSAENIVGIGKPSKVSECYVARDPCDPPGRPEAIIVTRNSVTLQWKKPTYDGGSKITGYIVEKKELPEGRWMKASFTNIIDTHFEVTGLVEDHRYEFRVIARNAAGVFSEPSESTGAITARDEVDPPRISMDPKYKDTIVVHAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQDGGSDIINYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSPPSAYQKACDPIYKPGPPNNPKVIDITRSSVFLSWSKPIYDGGCEIQGYIVEKCDVSVGEWTMCTPPTGINKTNIEVEKLLEKHEYNFRICAINKAGVGEHADVPGPIIVEEKLEAPDIDLDLELRKIINIRAGGSLRLFVPIKGRPTPEVKWGKVDGEIRDAAIIDVTSSFTSLVLDNVNRYDSGKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPISGRPKPTITWTKDGLPLKQTTRINVTDSLDLTTLSIKETHKDDGGQYGITVANVVGQKTASIEIVTLDKPDPPKGPVKFDDVSAESITLSWNPPLYTGGCQITNYIVQKRDTTTTVWDVVSATVARTTLKVTKLKTGTEYQFRIFAENRYGQSFALESDPIVAQYPYKEPGPPGTPFATAISKDSMVIQWHEPVNNGGSPVIGYHLERKERNSILWTKVNKTIIHDTQFKAQNLEEGIEYEFRVYAENIVGVGKASKNSECYVARDPCDPPGTPEPIMVKRNEITLQWTKPVYDGGSMITGYIVEKRDLPDGRWMKASFTNVIETQFTVSGLTEDQRYEFRVIAKNAAGAISKPSDSTGPITAKDEVELPRISMDPKFRDTIVVNAGETFRLEADVHGKPLPTIEWLRGDKEIEESARCEIKNTDFKALLIVKDAIRIDGGQYILRASNVAGSKSFPVNVKVLDRPGPPEGPVQVTGVTSEKCSLTWSPPLQDGGSDISHYVVEKRETSRLAWTVVASEVVTNSLKVTKLLEGNEYVFRIMAVNKYGVGEPLESAPVLMKNPFVLPGPPKSLEVTNIAKDSMTVCWNRPDSDGGSEIIGYIVEKRDRSGIRWIKCNKRRITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENEFGVGVPVETVDAVKAAEPPSPPGKVTLTDVSQTSASLMWEKPEHDGGSRVLGYVVEMQPKGTEKWSIVAESKVCNAVVTGLSSGQEYQFRVKAYNEKGKSDPRVLGVPVIAKDLTIQPSLKLPFNTYSIQAGEDLKIEIPVIGRPRPNISWVKDGEPLKQTTRVNVEETATSTVLHIKEGNKDDFGKYTVTATNSAGTATENLSVIVLEKPGPPVGPVRFDEVSADFVVISWEPPAYTGGCQISNYIVEKRDTTTTTWHMVSATVARTTIKITKLKTGTEYQFRIFAENRYGKSAPLDSKAVIVQYPFKEPGPPGTPFVTSISKDQMLVQWHEPVNDGGTKIIGYHLEQKEKNSILWVKLNKTPIQDTKFKTTGLDEGLEYEFKVSAENIVGIGKPSKVSECFVARDPCDPPGRPEAIVITRNNVTLKWKKPAYDGGSKITGYIVEKKDLPDGRWMKASFTNVLETEFTVSGLVEDQRYEFRVIARNAAGNFSEPSDSSGAITARDEIDAPNASLDPKYKDVIVVHAGETFVLEADIRGKPIPDVVWSKDGKELEETAARMEIKSTIQKTTLVVKDCIRTDGGQYILKLSNVGGTKSIPITVKVLDRPGPPEGPLKVTGVTAEKCYLAWNPPLQDGGANISHYIIEKRETSRLSWTQVSTEVQALNYKVTKLLPGNEYIFRVMAVNKYGIGEPLESGPVTACNPYKPPGPPSTPEVSAITKDSMVVTWARPVDDGGTEIEGYILEKRDKEGVRWTKCNKKTLTDLRLRVTGLTEGHSYEFRVAAENAAGVGEPSEPSVFYRACDALYPPGPPSNPKVTDTSRSSVSLAWSKPIYDGGAPVKGYVVEVKEAAADEWTTCTPPTGLQGKQFTVTKLKENTEYNFRICAINSEGVGEPATLPGSVVAQERIEPPEIELDADLRKVVVLRASATLRLFVTIKGRPEPEVKWEKAEGILTDRAQIEVTSSFTMLVIDNVTRFDSGRYNLTLENNSGSKTAFVNVRVLDSPSAPVNLTIREVKKDSVTLSWEPPLIDGGAKITNYIVEKRETTRKAYATITNNCTKTTFRIENLQEGCSYYFRVLASNEYGIGLPAETTEPVKVSEPPLPPGRVTLVDVTRNTATIKWEKPESDGGSKITGYVVEMQTKGSEKWSTCTQVKTLEATISGLTAGEEYVFRVAAVNEKGRSDPRQLGVPVIARDIEIKPSVELPFHTFNVKAREQLKIDVPFKGRPQATVNWRKDGQTLKETTRVNVSSSKTVTSLSIKEASKEDVGTYELCVSNSAGSITVPITIIVLDRPGPPGPIRIDEVSCDSITISWNPPEYDGGCQISNYIVEKKETTSTTWHIVSQAVARTSIKIVRLTTGSEYQFRVCAENRYGKSSYSESSAVVAEYPFSPPGPPGTPKVVHATKSTMLVTWQVPVNDGGSRVIGYHLEYKERSSILWSKANKILIADTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRYEFRVFARNAADSVSEPSESTGPIIVKDDVEPPRVMMDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNSLRWVRVNKKPVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTKESAVLSWDVPENDGGAPVKNYHIEKREASKKAWVSVTNNCNRLSYKVTNLQEGAIYYFRVSGENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSILWQKANKLVIRTTHFKVTTISAGLIYEFRVYAENAAGVGKPSHPSEPVLAIDACEPPRNVRITDISKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDARYSIENTDSSSLLTIPQVTRNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWRMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKDGGGTEITNYIVEKRESGTTAWQLVNSSVKRTQIKVTHLTKYMEYSFRVSSENRFGVSKPLESAPIIAEHPFVPPSAPTRPEVYHVSANAMSIRWEEPYHDGGSKIIGYWVEKKERNTILWVKENKVPCLECNYKVTGLVEGLEYQFRTYALNAAGVSKASEASRPIMAQNPVDAPGRPEVTDVTRSTVSLIWSAPAYDGGSKVVGYIIERKPVSEVGDGRWLKCNYTIVSDNFFTVTALSEGDTYEFRVLAKNAAGVISKGSESTGPVTCRDEYAPPKAELDARLHGDLVTIRAGSDLVLDAAVGGKPEPKIIWTKGDKELDLCEKVSLQYTGKRATAVIKFCDRSDSGKYTLTVKNASGTKAVSVMVKVLDSPGPCGKLTVSRVTQEKCTLAWSLPQEDGGAEITHYIVERRETSRLNWVIVEGECPTLSYVVTRLIKNNEYIFRVRAVNKYGPGVPVESEPIVARNSFTIPSPPGIPEEVGTGKEHIIIQWTKPESDGGNEISNYLVDKREKKSLRWTRVNKDYVVYDTRLKVTSLMEGCDYQFRVTAVNAAGNSEPSEASNFISCREPSYTPGPPSAPRVVDTTKHSISLAWTKPMYDGGTDIVGYVLEMQEKDTDQWYRVHTNATIRNTEFTVPDLKMGQKYSFRVAAVNVKGMSEYSESIAEIEPVERIEIPDLELADDLKKTVTIRAGASLRLMVSVSGRPPPVITWSKQGIDLASRAIIDTTESYSLLIVDKVNRYDAGKYTIEAENQSGKKSATVLVKVYDTPGPCPSVKVKEVSRDSVTITWEIPTIDGGAPVNNYIVEKREAAMRAFKTVTTKCSKTLYRISGLVEGTMYYFRVLPENIYGIGEPCETSDAVLVSEVPLVPAKLEVVDVTKSTVTLAWEKPLYDGGSRLTGYVLEACKAGTERWMKVVTLKPTVLEHTVTSLNEGEQYLFRIRAQNEKGVSEPRETVTAVTVQDLRVLPTIDLSTMPQKTIHVPAGRPVELVIPIAGRPPPAASWFFAGSKLRESERVTVETHTKVAKLTIRETTIRDTGEYTLELKNVTGTTSETIKVIILDKPGPPTGPIKIDEIDATSITISWEPPELDGGAPLSGYVVEQRDAHRPGWLPVSESVTRSTFKFTRLTEGNEYVFRVAATNRFGIGSYLQSEVIECRSSIRIPGPPETLQIFDVSRDGMTLTWYPPEDDGGSQVTGYIVERKEVRADRWVRVNKVPVTMTRYRSTGLTEGLEYEHRVTAINARGSGKPSRPSKPIVAMDPIAPPGKPQNPRVTDTTRTSVSLAWSVPEDEGGSKVTGYLIEMQKVDQHEWTKCNTTPTKIREYTLTHLPQGAEYRFRVLACNAGGPGEPAEVPGTVKVTEMLEYPDYELDERYQEGIFVRQGGVIRLTIPIKGKPFPICKWTKEGQDISKRAMIATSETHTELVIKEADRGDSGTYDLVLENKCGKKAVYIKVRVIGSPNSPEGPLEYDDIQVRSVRVSWRPPADDGGADILGYILERREVPKAAWYTIDSRVRGTSLVVKGLKENVEYHFRVSAENQFGISKPLKSEEPVTPKTPLNPPEPPSNPPEVLDVTKSSVSLSWSRPKDDGGSRVTGYYIERKETSTDKWVRHNKTQITTTMYTVTGLVPDAEYQFRIIAQNDVGLSETSPASEPVVCKDPFDKPSQPGELEILSISKDSVTLQWEKPECDGGKEILGYWVEYRQSGDSAWKKSNKERIKDKQFTIGGLLEATEYEFRVFAENETGLSRPRRTAMSIKTKLTSGEAPGIRKEMKDVTTKLGEAAQLSCQIVGRPLPDIKWYRFGKELIQSRKYKMSSDGRTHTLTVMTEEQEDEGVYTCIATNEVGEVETSSKLLLQATPQFHPGYPLKEKYYGAVGSTLRLHVMYIGRPVPAMTWFHGQKLLQNSENITIENTEHYTHLVMKNVQRKTHAGKYKVQLSNVFGTVDAILDVEIQDKPDKPTGPIVIEALLKNSAVISWKPPADDGGSWITNYVVEKCEAKEGAEWQLVSSAISVTTCRIVNLTENAGYYFRVSAQNTFGISDPLEVSSVVIIKSPFEKPGAPGKPTITAVTKDSCVVAWKPPASDGGAKIRNYYLEKREKKQNKWISVTTEEIRETVFSVKNLIEGLEYEFRVKCENLGGESEWSEISEPITPKSDVPIQAPHFKEELRNLNVRYQSNATLVCKVTGHPKPIVKWYRQGKEIIADGLKYRIQEFKGGYHQLIIASVTDDDATVYQVRATNQGGSVSGTASLEVEVPAKIHLPKTLEGMGAVHALRGEVVSIKIPFSGKPDPVITWQKGQDLIDNNGHYQVIVTRSFTSLVFPNGVERKDAGFYVVCAKNRFGIDQKTVELDVADVPDPPRGVKVSDVSRDSVNLTWTEPASDGGSKITNYIVEKCATTAERWLRVGQARETRYTVINLFGKTSYQFRVIAENKFGLSKPSEPSEPTITKEDKTRAMNYDEEVDETREVSMTKASHSSTKELYEKYMIAEDLGRGEFGIVHRCVETSSKKTYMAKFVKVKGTDQVLVKKEISILNIARHRNILHLHESFESMEELVMIFEFISGLDIFERINTSAFELNEREIVSYVHQVCEALQFLHSHNIGHFDIRPENIIYQTRRSSTIKIIEFGQARQLKPGDNFRLLFTAPEYYAPEVHQHDVVSTATDMWSLGTLVYVLLSGINPFLAETNQQIIENIMNAEYTFDEEAFKEISIEAMDFVDRLLVKERKSRMTASEALQHPWLKQKIERVSTKVIRTLKHRRYYHTLIKKDLNMVVSAARISCGGAIRSQKGVSVAKVKVASIEIGPVSGQIMHAVGEEGGHVKYVCKIENYDQSTQVTWYFGVRQLENSEKYEITYEDGVAILYVKDITKLDDGTYRCKVVNDYGEDSSYAELFVKGVREVYDYYCRRTMKKIKRRTDTMRLLERPPEFTLPLYNKTAYVGENVRFGVTITVHPEPHVTWYKSGQKIKPGDNDKKYTFESDKGLYQLTINSVTTDDDAEYTVVARNKYGEDSCKAKLTVTLHPPPTDSTLRPMFKRLLANAECQEGQSVCFEIRVSGIPPPTLKWEKDGQPLSLGPNIEIIHEGLDYYALHIRDTLPEDTGYYRVTATNTAGSTSCQAHLQVERLRYKKQEFKSKEEHERHVQKQIDKTLRMAEILSGTESVPLTQVAKEALREAAVLYKPAVSTKTVKGEFRLEIEEKKEERKLRMPYDVPEPRKYKQTTIEEDQRIKQFVPMSDMKWYKKIRDQYEMPGKLDRVVQKRPKRIRLSRWEQFYVMPLPRITDQYRPKWRIPKLSQDDLEIVRPARRRTPSPDYDFYYRPRRRSLGDISDEELLLPIDDYLAMKRTEEERLRLEEELELGFSASPPSRSPPHFELSSLRYSSPQAHVKVEETRKDFRYSTYHIPTKAEASTSYAELRERHAQAAYRQPKQRQRIMAEREDEELLRPVTTTQHLSEYKSELDFMSKEEKSRKKSRRQREVTEITEIEEEYEISKHAQRESSSSASRLLRRRRSLSPTYIELMRPVSELIRSRPQPAEEYEDDTERRSPTPERTRPRSPSPVSSERSLSRFERSARFDIFSRYESMKAALKTQKTSERKYEVLSQQPFTLDHAPRITLRMRSHRVPCGQNTRFILNVQSKPTAEVKWYHNGVELQESSKIHYTNTSGVLTLEILDCHTDDSGTYRAVCTNYKGEASDYATLDVTGGDYTTYASQRRDEEVPRSVFPELTRTEAYAVSSFKKTSEMEASSSVREVKSQMTETRESLSSYEHSASAEMKSAALEEKSLEEKSTTRKIKTTLAARILTKPRSMTVYEGESARFSCDTDGEPVPTVTWLRKGQVLSTSARHQVTTTKYKSTFEISSVQASDEGNYSVVVENSEGKQEAEFTLTIQKARVTEKAVTSPPRVKSPEPRVKSPEAVKSPKRVKSPEPSHPKAVSPTETKPTPTEKVQHLPVSAPPKITQFLKAEASKEIAKLTCVVESSVLRAKEVTWYKDGKKLKENGHFQFHYSADGTYELKINNLTESDQGEYVCEISGEGGTSKTNLQFMGQAFKSIHEKVSKISETKKSDQKTTESTVTRKTEPKAPEPISSKPVIVTGLQDTTVSSDSVAKFAVKATGEPRPTAIWTKDGKAITQGGKYKLSEDKGGFFLEIHKTDTSDSGLYTCTVKNSAGSVSSSCKLTIKAIKDTEAQKVSTQKTSEITPQKKAVVQEEISQKALRSEEIKMSEAKSQEKLALKEEASKVLISEEVKKSAATSLEKSIVHEEITKTSQASEEVRTHAEIKAFSTQMSINEGQRLVLKANIAGATDVKWVLNGVELTNSEEYRYGVSGSDQTLTIKQASHRDEGILTCISKTKEGIVKCQYDLTLSKELSDAPAFISQPRSQNINEGQNVLFTCEISGEPSPEIEWFKNNLPISISSNVSISRSRNVYSLEIRNASVSDSGKYTIKAKNFRGQCSATASLMVLPLVEEPSREVVLRTSGDTSLQGSFSSQSVQMSASKQEASFSSFSSSSASSMTEMKFASMSAQSMSSMQESFVEMSSSSFMGISNMTQLESSTSKMLKAGIRGIPPKIEALPSDISIDEGKVLTVACAFTGEPTPEVTWSCGGRKIHSQEQGRFHIENTDDLTTLIIMDVQKQDGGLYTLSLGNEFGSDSATVNIHIRSI

SEQ ID NO: 3312 - protein, 27118 aa, Homo sapiens
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDLRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENITSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEVQALDRQSSGKDVRESTKSQAVADSSFTKEESKISQKEIKSFQGSSYEYEVQVFESVSQSSIHTAASVQDTQLCHTASLSQIAESTELSKECAKESTGEAPKIFLHLQDVTVKCGDTAQFLCVLKDDSFIDVTWTHEGAKIEESERLKQSQNGNIQFLTICNVQLVDQGLYSCIVHNDCGERTTSAVLSVEGAPESILHERIEQEIEMEMKEFSSSFLSAEEEGLHSAELQLSKINETLELLSESPVYSTKFDSEKEGTGPIFIKEVSNADISMGDVATLSVTVIGIPKPKIQWFFNGVLLTPSADYKFVFDGDDHSLIILFTKLEDEGEYTCMASNDYGKTICSAYLKINSKGEGHKDTETESAVAKSLEKLGGPCPPHFLKELKPIRCAQGLPAIFEYTVVGEPAPTVTWFKENKQLCTSVYYTIIHNPNGSGTFIVNDPQREDSGLYICKAENMLGESTCAAELLVLLEDTDMTDTPCKAKSTPEAPEDFPQTPLKGPAVEALDSEQEIATFVKDTILKAALITEENQQLSYEHIAKANELSSQLPLGAQELQSILEQDKLTPESTREFLCINGSIHFQPLKEPSPNLQLQIVQSQKTFSKEGILMPEEPETQAVLSDTEKIFPSAMSIEQINSLTVEPLKTLLAEPEGNYPQSSIEPPMHSYLTSVAEEVLSPKEKTVSDTNREQRVTLQKQEAQSALILSQSLAEGHVESLQSPDVMISQVNYEPLVPSEHSCTEGGKILIESANPLENAGQDSAVRIEEGKSLRFPLALEEKQVLLKEEHSDNVVMPPDQIIESKREPVAIKKVQEVQGRDLLSKESLLSGIPEEQRLNLKIQICRALQAAVASEQPGLFSEWLRNIEKVEVEAVNITQEPRHIMCMYLVTSAKSVTEEVTIIIEDVDPQMANLKMELRDALCAIIYEEIDILTAEGPRIQQGAKTSLQEEMDSFSGSQKVEPITEPEVESKYLISTEEVSYFNVQSRVKYLDATPVTKGVASAVVSDEKQDESLKPSEEKEESSSESGTEEVATVKIQEAEGGLIKEDGPMIHTPLVDTVSEEGDIVHLTTSITNAKEVNWYFENKLVPSDEKFKCLQDQNTYTLVIDKVNTEDHQGEYVCEALNDSGKTATSAKLTVVKRAAPVIKRKIEPLEVALGHLAKFTCEIQSAPNVRFQWFKAGREIYESDKCSIRSSKYISSLEILRTQVVDCGEYTCKASNEYGSVSCTATLTVTVPGGEKKVRKLLPERKPEPKEEVVLKSVLRKRPEEEEPKVEPKKLEKVKKPAVPEPPPPKPVEEVEVPTVTKRERKIPEPTKVPEIKPAIPLPAPEPKPKPEAEVKTIKPPPVEPEPTPIAAPVTVPVVGKKAEAKAPKEEAAKPKGPIKGVPKKTPSPIEAERRKLRPGSGGEKPPDEAPFTYQLKAVPLKFVKEIKDIILTESEFVGSSAIFECLVSPSTAITTWMKDGSNIRESPKHRFIADGKDRKLHIIDVQLSDAGEYTCVLRLGNKEKTSTAKLVVEELPVRFVKTLEEEVTVVKGQPLYLSCELNKERDVVWRKDGKIVVEKPGRIVPGVIGLMRALTINDADDTDAGTYTVTVENANNLECSSCVKVVEVIRDWLVKPIRDQHVKPKGTAIFACDIAKDTPNIKWFKGYDEIPAEPNDKTEILRDGNHLYLKIKNAMPEDIAEYAVEIEGKRYPAKLTLGEREVELLKPIEDVTIYEKESASFDAEISEADIPGQWKLKGELLRPSPTCEIKAEGGKRFLTLHKVKLDQAGEVLYQALNAITTAILTVKEIELDFAVPLKDVTVPERRQARFECVLTREANVIWSKGPDIIKSSDKFDIIADGKKHILVINDSQFDDEGVYTAEVEGKKTSARLFVTGIRLKFMSPLEDQTVKEGETATFVCELSHEKMHVVWFKNDAKLHTSRTVLISSEGKTHKLEMKEVTLDDISQIKAQVKELSSTAQLKVLEADPYFTVKLHDKTAVEKDEITLKCEVSKDVPVKWFKDGEEIVPSPKYSIKADGLRRILKIKKADLKDKGEYVCDCGTDKTKANVTVEARLIKVEKPLYGVEVFVGETAHFEIELSEPDVHGQWKLKGQPLTASPDCEIIEDGKKHILILHNCQLGMTGEVSFQAANAKSAANLKVKELPLIFITPLSDVKVFEKDEAKFECEVSREPKTFRWLKGTQEITGDDRFELIKDGTKHSMVIKSAAFEDEAKYMFEAEDKHTSGKLIIEGIRLKFLTPLKDVTAKEKESAVFTVELSHDNIRVKWFKNDQRLHTTRSVSMQDEGKTHSITFKDLSIDDTSQIRVEAMGMSSEAKLTVLEGDPYFTGKLQDYTGVEKDEVILQCEISKADAPVKWFKDGKEIKPSKNAVIKADGKKRMLILKKALKSDIGQYTCDCGTDKTSGKLDIEDREIKLVRPLHSVEVMETETARFETEISEDDIHANWKLKGEALLQTPDCEIKEEGKIHSLVLHNCRLDQTGGVDFQAANVKSSAHLRVKPRVIGLLRPLKDVTVTAGETATFDCELSYEDIPVEWYLKGKKLEPSDKVVPRSEGKVHTLTLRDVKLEDAGEVQLTAKDFKTHANLFVKEPPVEFTKPLEDQTVEEGATAVLECEVSRENAKVKWFKNGTEILKSKKYEIVADGRVRKLVIHDCTPEDIKTYTCDAKDFKTSCNLNVVPPHVEFLRPLTDLQVREKEMARFECELSRENAKVKWFKDGAEIKKGKKYDIISKGAVRILVINKCLLDDEAEYSCEVRTARTSGMLTVLEEEAVFTKNLANIEVSETDTIKLVCEVSKPGAEVIWYKGDEEIIETGRYEILTEGRKRILVIQNAHLEDAGNYNCRLPSSRTDGKVKVHELAAEFISKPQNLEILEGEKAEFVCSISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPLKDIETMEKKSVTFWCKVNRLNVTLKWTKNGEEVPFDNRVSYRVDKYKHMLTIKDCGFPDEGEYIVTAGQDKSVAELLIIEAPTEFVEHLEDQTVTEFDDAVFSCQLSREKANVKWYRNGREIKEGKKYKFEKDGSIHRLIIKDCRLDDECEYACGVEDRKSRARLFVEEIPVEIIRPPQDILEAPGADVVFLAELNKDKVEVQWLRNNMVVVQGDKHQMMSEGKIHRLQICDIKPRDQGEYRFIAKDKEARAKLELAAAPKIKTADQDLVVDVGKPLTMVVPYDAYPKAEAEWFKENEPLSTKTIDTTAEQTSFRILEAKKGDKGRYKIVLQNKHGKAEGFINLKVIDVPGPVRNLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFVEPTMDLSAFKDGLEVIVPNPITILVPSTGYPRPTATWCFGDKVLETGDRVKMKTLSAYAELVISPSERSDKGIYTLKLENRVKTISGEIDVNVIARPSAPKELKFGDITKDSVHLTWEPPDDDGGSPLTGYVVEKREVSRKTWTKVMDFVTDLEFTVPDLVQGKEYLFKVCARNKCGPGEPAYVDEPVNMSTPATVPDPPENVKWRDRTANSIFLTWDPPKNDGGSRIKGYIVERCPRGSDKWVACGEPVAETKMEVTGLEEGKWYAYRVKALNRQGASKPSRPTEEIQAVDTQEAPEIFLDVKLLAGLTVKAGTKIELPATVTGKPEPKITWTKADMILKQDKRITIENVPKKSTVTIVDSKRSDTGTYIIEAVNVCGRATAVVEVNVLDKPGPPAAFDITDVTNESCLLTWNPPRDDGGSKITNYVVERRATDSEVWHKLSSTVKDTNFKATKLIPNKEYIFRVAAENMYGVGEPVQASPITAKYQFDPPGPPTRLEPSDITKDAVTLTWCEPDDDGGSPITGYWVERLDPDTDKWVRCNKMPVKDTTYRVKGLTNKKKYRFRVLAENLAGPGKPSKSTEPILIKDPIDPPWPPGKPTVKDVGKTSVRLNWTKPEHDGGAKIESYVIEMLKTGTDEWVRVAEGVPTTQHLLPGLMEGQEYSFRVRAVNKAGESEPSEPSDPVLCREKLYPPSPPRWLEVINITKNTADLKWTVPEKDGGSPITNYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWVKAGKTAGPDCNFRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKPTIDLETHDIIVIEGEKLSIPVPFRAVPVPTVSWHKDGKEVKASDRLTMKNDHISAHLEVPKSVRADAGIYTITLENKLGSATASINVKVIGLPGPCKDIKASDITKSSCKLTWEPPEFDGGTPILHYVLERREAGRRTYIPVMSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRATPPTKAVDPIDAPKVILRTSLEVKRGDEIALDASISGSPYPTITWIKDENVIVPEEIKKRAAPLVRRRKGEVQEEEPFVLPLTQRLSIDNSKKGESQLRVRDSLRPDHGLYMIKVENDHGIAKAPCTVSVLDTPGPPINFVFEDIRKTSVLCKWEPPLDDGGSEIINYTLEKKDKTKPDSEWIVVTSTLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPISPPGPPIPRVTDTSSTTIELEWEPPAFNGGGEIVGYFVDKQLVGTNEWSRCTEKMIKVRQYTVKEIREGADYKLRVSAVNAAGEGPPGETQPVTVAEPQEPPAVELDVSVKGGIQIMAGKTLRIPAVVTGRPVPTKVWTKEEGELDKDRVVIDNVGTKSELIIKDALRKDHGRYVITATNSCGSKFAAARVEVFDVPGPVLDLKPVVTNRKMCLLNWSDPEDDGGSEITGFIIERKDAKMHTWRQPIETERSKCDITGLLEGQEYKFRVIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKGTYTVTASNRLGSVFRNVHVEVYDRPSPPRNLAVTDIKAESCYLTWDAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKIGLITKNTVHLSWKPPKNDGGSPVTHYIVECLAWDPTGTKKEAWRQCNKRDVEELQFTVEDLVEGGEYEFRVKAVNAAGVSKPSATVGPCDCQRPDMPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFRVSAVNIAGIGEPGEVTDVIEMKDRLVSPDLQLDASVRDRIVVHAGGVIRIIAYVSGKPPPTVTWNMNERTLPQEATIETTAISSSMVIKNCQRSHQGVYSLLAKNEAGERKKTIIVDVLDVPGPVGTPFLAHNLTNESCKLTWFSPEDDGGSPITNYVIEKRESDRRAWTPVTYTVTRQNATVQGLIQGKAYFFRIAAENSIGMGPFVETSEALVIREPITVPERPEDLEVKEVTKNTVTLTWNPPKYDGGSEIINYVLESRLIGTEKFHKVTNDNLLSRKYTVKGLKEGDTYEYRVSAVNIVGQGKPSFCTKPITCKDELAPPTLHLDFRDKLTIRVGEAFALTGRYSGKPKPKVSWFKDEADVLEDDRTHIKTTPATLALEKIKAKRSDSGKYCVVVENSTGSRKGFCQVNVVDRPGPPVGPVSFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFPKVTWKKEDRDAPTKARIDVTPVGSKLEIRNAAHEDGGIYSLTVENPAGSKTVSVKVLVLDKPGPPRDLEVSEIRKDSCYLTWKEPLDDGGSVITNYVVERRDVASAQWSPLSATSKKKSHFAKHLNEGNQYLFRVAAENQYGRGPFVETPKPIKALDPLHPPGPPKDLHHVDVDKTEVSLVWNKPDRDGGSPITGYLVEYQEEGTQDWIKFKTVTNLECVVTGLQQGKTYRFRVKAENIVGLGLPDTTIPIECQEKLVPPSVELDVKLIEGLVVKAGTTVRFPAIIRGVPVPTAKWTTDGSEIKTDEHYTVETDNFSSVLTIKNCLRRDTGEYQITVSNAAGSKTVAVHLTVLDVPGPPTGPINILDVTPEHMTISWQPPKDDGGSPVINYIVEKQDTRKDTWGVVSSGSSKTKLKIPHLQKGCEYVFRVRAENKIGVGPPLDSTPTVAKHKFSPPSPPGKPVVTDITENAATVSWTLPKSDGGSPITGYYMERREVTGKWVRVNKTPIADLKFRVTGLYEGNTYEFRVFAENLAGLSKPSPSSDPIKACRPIKPPGPPINPKLKDKSRETADLVWTKPLSDGGSPILGYVVECQKPGTAQWNRINKDELIRQCAFRVPGLIEGNEYRFRIKAANIVGEGEPRELAESVIAKDILHPPEVELDVTCRDVITVRVGQTIRILARVKGRPEPDITWTKEGKVLVREKRVDLIQDLPRVELQIKEAVRADHGKYIISAKNSSGHAQGSAIVNVLDRPGPCQNLKVTNVTKENCTISWENPLDNGGSEITNFIVEYRKPNQKGWSIVASDVTKRLIKANLLANNEYYFRVCAENKVGVGPTIETKTPILAINPIDRPGEPENLHIADKGKTFVYLKWRRPDYDGGSPNLSYHVERRLKGSDDWERVHKGSIKETHYMVDRCVENQIYEFRVQTKNEGGESDWVKTEEVVVKEDLQKPVLDLKLSGVLTVKAGDTIRLEAGVRGKPFPEVAWTKDKDATDLTRSPRVKIDTRADSSKFSLTKAKRSDGGKYVVTATNTAGSFVAYATVNVLDKPGPVRNLKIVDVSSDRCTVCWDPPEDDGGCEIQNYILEKCETKRMVWSTYSATVLTPGTTVTRLIEGNEYIFRVRAENKIGTGPPTESKPVIAKTKYDKPGRPDPPEVTKVSKEEMTVVWNPPEYDGGKSITGYFLEKKEKHSTRWVPVNKSAIPERRMKVQNLLPDHEYQFRVKAENEIGIGEPSLPSRPVVAKDPIEPPGPPTNFRVVDTTKHSITLGWGKPVYDGGAPIIGYVVEMRPKIADASPDEGWKRCNAAAQLVRKEFTVTSLDENQEYEFRVCAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVNPAGEKAVFVNVRVLDTPGPVSDLKVSDVTKTSCHVSWAPPENDGGSQVTHYIVEKREADRKTWSTVTPEVKKTSFHVTNLVPGNEYYFRVTAVNEYGPGVPTDVPKPVLASDPLSEPDPPRKLEVTEMTKNSATLAWLPPLRDGGAKIDGYITSYREEEQPADRWTEYSVVKDLSLVVTGLKEGKKYKFRVAARNAVGVSLPREAEGVYEAKEQLLPPKILMPEQITIKAGKKLRIEAHVYGKPHPTCKWKKGEDEVVTSSHLAVHKADSSSILIIKDVTRKDSGYYSLTAENSSGTDTQKIKVVVMDAPGPPQPPFDISDIDADACSLSWHIPLEDGGSNITNYIVEKCDVSRGDWVTALASVTKTSCRVGKLIPGQEYIFRVRAENRFGISEPLTSPKMVAQFPFGVPSEPKNARVTKVNKDCIFVAWDRPDSDGGSPIIGYLIERKERNSLLWVKANDTLVRSTEYPCAGLVEGLEYSFRIYALNKAGSSPPSKPTEYVTARMPVDPPGKPEVIDVTKSTVSLIWARPKHDGGSKIIGYFVEACKLPGDKWVRCNTAPHQIPQEEYTATGLEEKAQYQFRAIARTAVNISPPSEPSDPVTILAENVPPRIDLSVAMKSLLTVKAGTNVCLDATVFGKPMPTVSWKKDGTLLKPAEGIKMAMQRNLCTLELFSVNRKDSGDYTITAENSSGSKSATIKLKVLDKPGPPASVKINKMYSDRAMLSWEPPLEDGGSEITNYIVDKRETSRPNWAQVSATVPITSCSVEKLIEGHEYQFRICAENKYGVGDPVFTEPAIAKNPYDPPGRCDPPVISNITKDHMTVSWKPPADDGGSPITGYLLEKRETQAVNWTKVNRKPIIERTLKATGLQEGTEYEFRVTAINKAGPGKPSDASKAAYARDPQYPPAPPAFPKVYDTTRSSVSLSWGKPAYDGGSPIIGYLVEVKRADSDNWVRCNLPQNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVLDTPGPPVNVTVKEISKDSAYVTWEPPIIDGGSPIINYVVQKRDAERKSWSTVTTECSKTSFRVANLEEGKSYFFRVFAENEYGIGDPGETRDAVKASQTPGPVVDLKVRSVSKSSCSIGWKKPHSDGGSRIIGYVVDFLTEENKWQRVMKSLSLQYSAKDLTEGKEYTFRVSAENENGEGTPSEITVVARDDVVAPDLDLKGLPDLCYLAKENSNFRLKIPIKGKPAPSVSWKKGEDPLATDTRVSVESSAVNTTLIVYDCQKSDAGKYTITLKNVAGTKEGTISIKVVGKPGIPTGPIKFDEVTAEAMTLKWAPPKDDGGSEITNYILEKRDSVNNKWVTCASAVQKTTFRVTRLHEGMEYTFRVSAENKYGVGEGLKSEPIVARHPFDVPDAPPPPNIVDVRHDSVSLTWTDPKKTGGSPITGYHLEFKERNSLLWKRANKTPIRMRDFKVTGLTEGLEYEFRVMAINLAGVGKPSLPSEPVVALDPIDPPGKPEVINITRNSVTLIWTEPKYDGGHKLTGYIVEKRDLPSKSWMKANHVNVPECAFTVTDLVEGGKYEFRIRAKNTAGAISAPSESTETIICKDEYEAPTIVLDPTIKDGLTIKAGDTIVLNAISILGKPLPKSSWSKAGKDIRPSDITQITSTPTSSMLTIKYATRKDAGEYTITATNPFGTKVEHVKVTVLDVPGPPGPVEISNVSAEKATLTWTPPLEDGGSPIKSYILEKRETSRLLWTVVSEDIQSCRHVATKLIQGNEYIFRVSAVNHYGKGEPVQSEPVKMVDRFGPPGPPEKPEVSNVTKNTATVSWKRPVDDGGSEITGYHVERREKKSLRWVRAIKTPVSDLRCKVTGLQEGSTYEFRVSAENRAGIGPPSEASDSVLMKDAAYPPGPPSNPHVTDTTKKSASLAWGKPHYDGGLEITGYVVEHQKVGDEAWIKDTTGTALRITQFVVPDLQTKEKYNFRISAINDAGVGEPAVIPDVEIVEREMAPDFELDAELRRTLVVRAGLSIRIFVPIKGRPAPEVTWTKDNINLKNRANIENTESFTLLIIPECNRYDTGKFVMTIENPAGKKSGFVNVRVLDTPGPVLNLRPTDITKDSVTLHWDLPLIDGGSRITNYIVEKREATRKSYSTATTKCHKCTYKVTGLSEGCEYFFRVMAENEYGIGEPTETTEPVKASEAPSPPDSLNIMDITKSTVSLAWPKPKHDGGSKITGYVIEAQRKGSDQWTHITTVKGLECVVRNLTEGEEYTFQVMAVNSAGRSAPRESRPVIVKEQTMLPELDLRGIYQKLVIAKAGDNIKVEIPVLGRPKPTVTWKKGDQILKQTQRVNFETTATSTILNINECVRSDSGPYPLTARNIVGEVGDVITIQVHDIPGPPTGPIKFDEVSSDFVTFSWDPPENDGGVPISNYVVEMRQTDSTTWVELATTVIRTTYKATRLTTGLEYQFRVKAQNRYGVGPGITSACIVANYPFKVPGPPGTPQVTAVTKDSMTISWHEPLSDGGSPILGYHVERKERNGILWQTVSKALVPGNIFKSSGLTDGIAYEFRVIAENMAGKSKPSKPSEPMLALDPIDPPGKPVPLNITRHTVTLKWAKPEYTGGFKITSYIVEKRDLPNGRWLKANFSNILENEFTVSGLTEDAAYEFRVIAKNAAGAISPPSEPSDAITCRDDVEAPKIKVDVKFKDTVILKAGEAFRLEADVSGRPPPTMEWSKDGKELEGTAKLEIKIADFSTNLVNKDSTRRDSGAYTLTATNPGGFAKHIFNVKVLDRPGPPEGPLAVTEVTSEKCVLSWFPPLDDGGAKIDHYIVQKRETSRLAWTNVASEVQVTKLKVTKLLKGNEYIFRVMAVNKYGVGEPLESEPVLAVNPYGPPDPPKNPEVTTITKDSMVVCWGHPDSDGGSEIINYIVERRDKAGQRWIKCNKKTLTDLRYKVSGLTEGHEYEFRIMAENAAGISAPSPTSPFYKACDTVFKPGPPGNPRVLDTSRSSISIAWNKPIYDGGSEITGYMVEIALPEEDEWQIVTPPAGLKATSYTITGLTENQEYKIRIYAMNSEGLGEPALVPGTPKAEDRMLPPEIELDADLRKVVTIRACCTLRLFVPIKGRPAPEVKWARDHGESLDKASIESTSSYTLLIVGNVNRFDSGKYILTVENSSGSKSAFVNVRVLDTPGPPQDLKVKEVTKTSVTLTWDPPLLDGGSKIKNYIVEKRESTRKAYSTVATNCHKTSWKVDQLQEGCSYYFRVLAENEYGIGLPAETAESVKASERPLPPGKITLMDVTRNSVSLSWEKPEHDGGSRILGYIVEMQTKGSDKWATCATVKVTEATITGLIQGEEYSFRVSAQNEKGISDPRQLSVPVIAKDLVIPPAFKLLFNTFTVLAGEDLKVDVPFIGRPTPAVTWHKDNVPLKQTTRVNAESTENNSLLTIKDACREDVGHYVVKLTNSAGEAIETLNVIVLDKPGPPTGPVKMDEVTADSITLSWGPPKYDGGSSINNYIVEKRDTSTTTWQIVSATVARTTIKACRLKTGCEYQFRIAAENRYGKSTYLNSEPTVAQYPFKVPGPPGTPVVTLSSRDSMEVQWNEPISDGGSRVIGYHLERKERNSILWVKLNKTPIPQTKFKTTGLEEGVEYEFRVSAENIVGIGKPSKVSECYVARDPCDPPGRPEAIIVTRNSVTLQWKKPTYDGGSKITGYIVEKKELPEGRWMKASFTNIIDTHFEVTGLVEDHRYEFRVIARNAAGVFSEPSESTGAITARDEVDPPRISMDPKYKDTIVVHAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQDGGSDIINYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSPPSAYQKACDPIYKPGPPNNPKVIDITRSSVFLSWSKPIYDGGCEIQGYIVEKCDVSVGEWTMCTPPTGINKTNIEVEKLLEKHEYNFRICAINKAGVGEHADVPGPIIVEEKLEAPDIDLDLELRKIINIRAGGSLRLFVPIKGRPTPEVKWGKVDGEIRDAAIIDVTSSFTSLVLDNVNRYDSGKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPISGRPKPTITWTKDGLPLKQTTRINVTDSLDLTTLSIKETHKDDGGQYGITVANVVGQKTASIEIVTLDKPDPPKGPVKFDDVSAESITLSWNPPLYTGGCQITNYIVQKRDTTTTVWDVVSATVARTTLKVTKLKTGTEYQFRIFAENRYGQSFALESDPIVAQYPYKEPGPPGTPFATAISKDSMVIQWHEPVNNGGSPVIGYHLERKERNSILWTKVNKTIIHDTQFKAQNLEEGIEYEFRVYAENIVGVGKASKNSECYVARDPCDPPGTPEPIMVKRNEITLQWTKPVYDGGSMITGYIVEKRDLPDGRWMKASFTNVIETQFTVSGLTEDQRYEFRVIAKNAAGAISKPSDSTGPITAKDEVELPRISMDPKFRDTIVVNAGETFRLEADVHGKPLPTIEWLRGDKEIEESARCEIKNTDFKALLIVKDAIRIDGGQYILRASNVAGSKSFPVNVKVLDRPGPPEGPVQVTGVTSEKCSLTWSPPLQDGGSDISHYVVEKRETSRLAWTVVASEVVTNSLKVTKLLEGNEYVFRIMAVNKYGVGEPLESAPVLMKNPFVLPGPPKSLEVTNIAKDSMTVCWNRPDSDGGSEIIGYIVEKRDRSGIRWIKCNKRRITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENEFGVGVPVETVDAVKAAEPPSPPGKVTLTDVSQTSASLMWEKPEHDGGSRVLGYVVEMQPKGTEKWSIVAESKVCNAVVTGLSSGQEYQFRVKAYNEKGKSDPRVLGVPVIAKDLTIQPSLKLPFNTYSIQAGEDLKIEIPVIGRPRPNISWVKDGEPLKQTTRVNVEETATSTVLHIKEGNKDDFGKYTVTATNSAGTATENLSVIVLEKPGPPVGPVRFDEVSADFVVISWEPPAYTGGCQISNYIVEKRDTTTTTWHMVSATVARTTIKITKLKTGTEYQFRIFAENRYGKSAPLDSKAVIVQYPFKEPGPPGTPFVTSISKDQMLVQWHEPVNDGGTKIIGYHLEQKEKNSILWVKLNKTPIQDTKFKTTGLDEGLEYEFKVSAENIVGIGKPSKVSECFVARDPCDPPGRPEAIVITRNNVTLKWKKPAYDGGSKITGYIVEKKDLPDGRWMKASFTNVLETEFTVSGLVEDQRYEFRVIARNAAGNFSEPSDSSGAITARDEIDAPNASLDPKYKDVIVVHAGETFVLEADIRGKPIPDVVWSKDGKELEETAARMEIKSTIQKTTLVVKDCIRTDGGQYILKLSNVGGTKSIPITVKVLDRPGPPEGPLKVTGVTAEKCYLAWNPPLQDGGANISHYIIEKRETSRLSWTQVSTEVQALNYKVTKLLPGNEYIFRVMAVNKYGIGEPLESGPVTACNPYKPPGPPSTPEVSAITKDSMVVTWARPVDDGGTEIEGYILEKRDKEGVRWTKCNKKTLTDLRLRVTGLTEGHSYEFRVAAENAAGVGEPSEPSVFYRACDALYPPGPPSNPKVTDTSRSSVSLAWSKPIYDGGAPVKGYVVEVKEAAADEWTTCTPPTGLQGKQFTVTKLKENTEYNFRICAINSEGVGEPATLPGSVVAQERIEPPEIELDADLRKVVVLRASATLRLFVTIKGRPEPEVKWEKAEGILTDRAQIEVTSSFTMLVIDNVTRFDSGRYNLTLENNSGSKTAFVNVRVLDSPSAPVNLTIREVKKDSVTLSWEPPLIDGGAKITNYIVEKRETTRKAYATITNNCTKTTFRIENLQEGCSYYFRVLASNEYGIGLPAETTEPVKVSEPPLPPGRVTLVDVTRNTATIKWEKPESDGGSKITGYVVEMQTKGSEKWSTCTQVKTLEATISGLTAGEEYVFRVAAVNEKGRSDPRQLGVPVIARDIEIKPSVELPFHTFNVKAREQLKIDVPFKGRPQATVNWRKDGQTLKETTRVNVSSSKTVTSLSIKEASKEDVGTYELCVSNSAGSITVPITIIVLDRPGPPGPIRIDEVSCDSITISWNPPEYDGGCQISNYIVEKKETTSTTWHIVSQAVARTSIKIVRLTTGSEYQFRVCAENRYGKSSYSESSAVVAEYPFSPPGPPGTPKVVHATKSTMLVTWQVPVNDGGSRVIGYHLEYKERSSILWSKANKILIADTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRYEFRVFARNAADSVSEPSESTGPIIVKDDVEPPRVMMDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNSLRWVRVNKKPVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTKESAVLSWDVPENDGGAPVKNYHIEKREASKKAWVSVTNNCNRLSYKVTNLQEGAIYYFRVSGENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSILWQKANKLVIRTTHFKVTTISAGLIYEFRVYAENAAGVGKPSHPSEPVLAIDACEPPRNVRITDISKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDARYSIENTDSSSLLTIPQVTRNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWRMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKDGGGTEITNYIVEKRESGTTAWQLVNSSVKRTQIKVTHLTKYMEYSFRVSSENRFGVSKPLESAPIIAEHPFVPPSAPTRPEVYHVSANAMSIRWEEPYHDGGSKIIGYWVEKKERNTILWVKENKVPCLECNYKVTGLVEGLEYQFRTYALNAAGVSKASEASRPIMAQNPVDAPGRPEVTDVTRSTVSLIWSAPAYDGGSKVVGYIIERKPVSEVGDGRWLKCNYTIVSDNFFTVTALSEGDTYEFRVLAKNAAGVISKGSESTGPVTCRDEYAPPKAELDARLHGDLVTIRAGSDLVLDAAVGGKPEPKIIWTKGDKELDLCEKVSLQYTGKRATAVIKFCDRSDSGKYTLTVKNASGTKAVSVMVKVLDSPGPCGKLTVSRVTQEKCTLAWSLPQEDGGAEITHYIVERRETSRLNWVIVEGECPTLSYVVTRLIKNNEYIFRVRAVNKYGPGVPVESEPIVARNSFTIPSPPGIPEEVGTGKEHIIIQWTKPESDGGNEISNYLVDKREKKSLRWTRVNKDYVVYDTRLKVTSLMEGCDYQFRVTAVNAAGNSEPSEASNFISCREPSYTPGPPSAPRVVDTTKHSISLAWTKPMYDGGTDIVGYVLEMQEKDTDQWYRVHTNATIRNTEFTVPDLKMGQKYSFRVAAVNVKGMSEYSESIAEIEPVERIEIPDLELADDLKKTVTIRAGASLRLMVSVSGRPPPVITWSKQGIDLASRAIIDTTESYSLLIVDKVNRYDAGKYTIEAENQSGKKSATVLVKVYDTPGPCPSVKVKEVSRDSVTITWEIPTIDGGAPVNNYIVEKREAAMRAFKTVTTKCSKTLYRISGLVEGTMYYFRVLPENIYGIGEPCETSDAVLVSEVPLVPAKLEVVDVTKSTVTLAWEKPLYDGGSRLTGYVLEACKAGTERWMKVVTLKPTVLEHTVTSLNEGEQYLFRIRAQNEKGVSEPRETVTAVTVQDLRVLPTIDLSTMPQKTIHVPAGRPVELVIPIAGRPPPAASWFFAGSKLRESERVTVETHTKVAKLTIRETTIRDTGEYTLELKNVTGTTSETIKVIILDKPGPPTGPIKIDEIDATSITISWEPPELDGGAPLSGYVVEQRDAHRPGWLPVSESVTRSTFKFTRLTEGNEYVFRVAATNRFGIGSYLQSEVIECRSSIRIPGPPETLQIFDVSRDGMTLTWYPPEDDGGSQVTGYIVERKEVRADRWVRVNKVPVTMTRYRSTGLTEGLEYEHRVTAINARGSGKPSRPSKPIVAMDPIAPPGKPQNPRVTDTTRTSVSLAWSVPEDEGGSKVTGYLIEMQKVDQHEWTKCNTTPTKIREYTLTHLPQGAEYRFRVLACNAGGPGEPAEVPGTVKVTEMLEYPDYELDERYQEGIFVRQGGVIRLTIPIKGKPFPICKWTKEGQDISKRAMIATSETHTELVIKEADRGDSGTYDLVLENKCGKKAVYIKVRVIGSPNSPEGPLEYDDIQVRSVRVSWRPPADDGGADILGYILERREVPKAAWYTIDSRVRGTSLVVKGLKENVEYHFRVSAENQFGISKPLKSEEPVTPKTPLNPPEPPSNPPEVLDVTKSSVSLSWSRPKDDGGSRVTGYYIERKETSTDKWVRHNKTQITTTMYTVTGLVPDAEYQFRIIAQNDVGLSETSPASEPVVCKDPFDKPSQPGELEILSISKDSVTLQWEKPECDGGKEILGYWVEYRQSGDSAWKKSNKERIKDKQFTIGGLLEATEYEFRVFAENETGLSRPRRTAMSIKTKLTSGEAPGIRKEMKDVTTKLGEAAQLSCQIVGRPLPDIKWYRFGKELIQSRKYKMSSDGRTHTLTVMTEEQEDEGVYTCIATNEVGEVETSSKLLLQATPQFHPGYPLKEKYYGAVGSTLRLHVMYIGRPVPAMTWFHGQKLLQNSENITIENTEHYTHLVMKNVQRKTHAGKYKVQLSNVFGTVDAILDVEIQDKPDKPTGPIVIEALLKNSAVISWKPPADDGGSWITNYVVEKCEAKEGAEWQLVSSAISVTTCRIVNLTENAGYYFRVSAQNTFGISDPLEVSSVVIIKSPFEKPGAPGKPTITAVTKDSCVVAWKPPASDGGAKIRNYYLEKREKKQNKWISVTTEEIRETVFSVKNLIEGLEYEFRVKCENLGGESEWSEISEPITPKSDVPIQAPHFKEELRNLNVRYQSNATLVCKVTGHPKPIVKWYRQGKEIIADGLKYRIQEFKGGYHQLIIASVTDDDATVYQVRATNQGGSVSGTASLEVEVPAKIHLPKTLEGMGAVHALRGEVVSIKIPFSGKPDPVITWQKGQDLIDNNGHYQVIVTRSFTSLVFPNGVERKDAGFYVVCAKNRFGIDQKTVELDVADVPDPPRGVKVSDVSRDSVNLTWTEPASDGGSKITNYIVEKCATTAERWLRVGQARETRYTVINLFGKTSYQFRVIAENKFGLSKPSEPSEPTITKEDKTRAMNYDEEVDETREVSMTKASHSSTKELYEKYMIAEDLGRGEFGIVHRCVETSSKKTYMAKFVKVKGTDQVLVKKEISILNIARHRNILHLHESFESMEELVMIFEFISGLDIFERINTSAFELNEREIVSYVHQVCEALQFLHSHNIGHFDIRPENIIYQTRRSSTIKIIEFGQARQLKPGDNFRLLFTAPEYYAPEVHQHDVVSTATDMWSLGTLVYVLLSGINPFLAETNQQIIENIMNAEYTFDEEAFKEISIEAMDFVDRLLVKERKSRMTASEALQHPWLKQKIERVSTKVIRTLKHRRYYHTLIKKDLNMVVSAARISCGGAIRSQKGVSVAKVKVASIEIGPVSGQIMHAVGEEGGHVKYVCKIENYDQSTQVTWYFGVRQLENSEKYEITYEDGVAILYVKDITKLDDGTYRCKVVNDYGEDSSYAELFVKGVREVYDYYCRRTMKKIKRRTDTMRLLERPPEFTLPLYNKTAYVGENVRFGVTITVHPEPHVTWYKSGQKIKPGDNDKKYTFESDKGLYQLTINSVTTDDDAEYTVVARNKYGEDSCKAKLTVTLHPPPTDSTLRPMFKRLLANAECQEGQSVCFEIRVSGIPPPTLKWEKDGQPLSLGPNIEIIHEGLDYYALHIRDTLPEDTGYYRVTATNTAGSTSCQAHLQVERLRYKKQEFKSKEEHERHVQKQIDKTLRMAEILSGTESVPLTQVAKEALREAAVLYKPAVSTKTVKGEFRLEIEEKKEERKLRMPYDVPEPRKYKQTTIEEDQRIKQFVPMSDMKWYKKIRDQYEMPGKLDRVVQKRPKRIRLSRWEQFYVMPLPRITDQYRPKWRIPKLSQDDLEIVRPARRRTPSPDYDFYYRPRRRSLGDISDEELLLPIDDYLAMKRTEEERLRLEEELELGFSASPPSRSPPHFELSSLRYSSPQAHVKVEETRKDFRYSTYHIPTKAEASTSYAELRERHAQAAYRQPKQRQRIMAEREDEELLRPVTTTQHLSEYKSELDFMSKEEKSRKKSRRQREVTEITEIEEEYEISKHAQRESSSSASRLLRRRRSLSPTYIELMRPVSELIRSRPQPAEEYEDDTERRSPTPERTRPRSPSPVSSERSLSRFERSARFDIFSRYESMKAALKTQKTSERKYEVLSQQPFTLDHAPRITLRMRSHRVPCGQNTRFILNVQSKPTAEVKWYHNGVELQESSKIHYTNTSGVLTLEILDCHTDDSGTYRAVCTNYKGEASDYATLDVTGGDYTTYASQRRDEEVPRSVFPELTRTEAYAVSSFKKTSEMEASSSVREVKSQMTETRESLSSYEHSASAEMKSAALEEKSLEEKSTTRKIKTTLAARILTKPRSMTVYEGESARFSCDTDGEPVPTVTWLRKGQVLSTSARHQVTTTKYKSTFEISSVQASDEGNYSVVVENSEGKQEAEFTLTIQKARVTEKAVTSPPRVKSPEPRVKSPEAVKSPKRVKSPEPSHPKAVSPTETKPTPTEKVQHLPVSAPPKITQFLKAEASKEIAKLTCVVESSVLRAKEVTWYKDGKKLKENGHFQFHYSADGTYELKINNLTESDQGEYVCEISGEGGTSKTNLQFMGQAFKSIHEKVSKISETKKSDQKTTESTVTRKTEPKAPEPISSKPVIVTGLQDTTVSSDSVAKFAVKATGEPRPTAIWTKDGKAITQGGKYKLSEDKGGFFLEIHKTDTSDSGLYTCTVKNSAGSVSSSCKLTIKAIKDTEAQKVSTQKTSEITPQKKAVVQEEISQKALRSEEIKMSEAKSQEKLALKEEASKVLISEEVKKSAATSLEKSIVHEEITKTSQASEEVRTHAEIKAFSTQMSINEGQRLVLKANIAGATDVKWVLNGVELTNSEEYRYGVSGSDQTLTIKQASHRDEGILTCISKTKEGIVKCQYDLTLSKELSDAPAFISQPRSQNINEGQNVLFTCEISGEPSPEIEWFKNNLPISISSNVSISRSRNVYSLEIRNASVSDSGKYTIKAKNFRGQCSATASLMVLPLVEEPSREVVLRTSGDTSLQGSFSSQSVQMSASKQEASFSSFSSSSASSMTEMKFASMSAQSMSSMQESFVEMSSSSFMGISNMTQLESSTSKMLKAGIRGIPPKIEALPSDISIDEGKVLTVACAFTGEPTPEVTWSCGGRKIHSQEQGRFHIENTDDLTTLIIMDVQKQDGGLYTLSLGNEFGSDSATVNIHIRSI

SEQ ID NO: 3313 - protein, 77 aa, Homo sapiens
MFHPNVYADGSICLDILQNRWSPTYDVSSILTSIQSLLDEPNPNSPANSQAAQLYQENKREYEKRVSAIVEQSWRDC

SEQ ID NO: 3314 - protein, 1180 aa, Homo sapiens
MPDLRRKKTLPIVRDVAMTLAARKSGLSLAMVIRTSLNNEELKMHVFKKTLQALIYPMSSTIPHNFEVWTATTPTYCYECEGLLWGIARQGMKCLECGVKCHEKCQDLLNADCLQRAAEKSSKHGAEDKTQTIITAMKERMKIREKNRPEVFEVIQEMFQISKEDFVQFTKAAKQSVLDGTSKWSAKITITVVSAQGLQAKDKTGSSDPYVTVQVGKNKRRTKTIFGNLNPVWDEKFYFECHNSTDRIKVRVWDEDDDIKSRVKQHFKKESDDFLGQTIVEVRTLSGEMDVWYNLEKRTDKSAVSGAIRLKINVEIKGEEKVAPYHIQYTCLHENLFHYLTEVKSNGGVKIPEVKGDEAWKVFFDDASQEIVDEFAMRYGIESIYQAMTHFSCLSSKYMCPGVPAVMSTLLANINAFYAHTTVSTNIQVSASDRFAATNFGREKFIKLLDQLHNSLRIDLSKYRENFPASNTERLQDLKSTVDLLTSITFFRMKVLELQSPPKASMVVKDCVRACLDSTYKYIFDNCHELYSQLTDPSKKQDIPREDQGPTTKNLDFWPQLITLMVTIIDEDKTAYTPVLNQFPQELNMGKISAEIMWTLFALDMKYALEEHENQRLCKSTDYMNLHFKVKWFYNEYVRELPAFKDAVPEYSLWFEPFVMQWLDENEDVSMEFLHGALGRDKKDGFQQTSEHALFSCSVVDVFAQLNQSFEIIKKLECPNPEALSHLMRRFAKTINKVLLQYAAIVSSDFSSHCDKENVPCILMNNIQQLRVQLEKMFESMGGKELDSEASTILKELQVKLSGVLDELSVTYGESFQVIIEECIKQMSFELNQMRANGNTTSNKNSAAMDAEIVLRSLMDFLDKTLSLSAKICEKTVLKRVLKELWKLVLNKIEKQIVLPPLTDQTGPQMIFIAAKDLGQLSKLKEHMIREDARGLTPRQCAIMEVVLATIKQYFHAGGNGLKKNFLEKSPDLQSLRYALSLYTQTTDALIKKFIDTQTSQSRSSKDAVGQISVHVDITATPGTGDHKVTVKVIAINDLNWQTTAMFRPFVEVCILGPNLGDKKRKQGTKTKSNTWSPKYNETFQFILGKENRPGAYELHLSVKDYCFAREDRIIGMTVIQLQNIAEKGSYGAWYPLLKNISMDETGLTILRILSQRTSDDVAKEFVRLKSETRSTEESA

SEQ ID NO: 3315 - protein, 1180 aa, Homo sapiens; identical to SEQ ID NO: 3314

SEQ ID NO: 3316 - protein, 963 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKSSTAPSRNFTTSPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 3317 - protein, 916 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSNGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 3318 - protein, 569 aa, Homo sapiens
MLKEWAIKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSRLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQIDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHGVKSAWN

SEQ ID NO: 3319 - protein, 3135 aa, Homo sapiens
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQVMENGRFAKYKYFTHVMINKTDMLMITRRGVLFVTKGTFGQLTCEWQYSFDEFTKEPFIVHGRRLRIEAKERVKSVFHAREFGKIINFKTPEDARWILTKLQEAREPSPSL

SEQ ID NO: 3320 - protein, 3069 aa, Homo sapiens
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQASKSLI

SEQ ID NO: 3321 - protein, 3095 aa, Homo sapiens
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQKIQFYREWIMTHSSSSDDDDDDDDDDESDLNH

SEQ ID NO: 3322 - protein, 3174 aa, Homo sapiens
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQVMENGRFAKYKYFTHVMINKTDMLMITRRGVLFVTKGTFGQLTCEWQYSFDEFTKEPFIVHGRRLRIEAKERVKSVFHAREFGKIINFKTPEDARWILTKLQEAREPSPSL

SEQ ID NO: 3323 - protein, 397 aa, Homo sapiens
MSWLFPLTKSASSSAAGSPGGLTSLQQQKQRLIESLRNSHSSIAEIQKDVEYRLPFTINNLTININILLPPQFPQEKPVISVYPPIRHHLMDKQGVYVTSPLVNNFTMHSDLGKIIQSLLDEFWKNPPVLAPTSTAFPYLYSNPSGMSPYASQGFPFLPPYPPQEANRSITSLSVADTVSSSTTSHTTAKPAAPSFGVLSNLPLPIPTVDASIPTSQNGFGYKMPDVPDAFPELSELSVSQLTDMNEQEEVLLEQFLTLPQLKQIITDKDDLVKSIEELARKNLLLEPSLEAKRQTVLDKYELLTQMKSTFERKMQRQHELSESCSASALQARLKVAAHEAEEESDNIAEDFLEGKMEIDDFLSSFMEKRTICHCRRAKEEKLQQAIAMHSQFHAPL

SEQ ID NO: 3324 - protein, 920 aa, Homo sapiens
MTAEETVNVKEVEIIKLILDFLNSKKLHISMLALEKESGVINGLFSDDMLFLRQLILDGQWDEVLQFIQPLECMEKFDKKRFRYIILKQKFLEALCVNNAMSAEDEPQHLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERSDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVGFWDLRVPSCARVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 3325 - protein, 1066 aa, Homo sapiens
MEPGKRRTKDDTWKADDLRKHLWAIQSGGSKEERKHREKKLRKESEMDLPEHKEPRCRDPDQDARSRDRVAEVHTAKESPRGERDRDRQRERRRDAKDREKEKLKEKHREAEKSHSRGKDREKEKDRRARKEELRQTVAHHNLLGQETRDRQLLERAERKGRSVSKVRSEEKDEDSERGDEDRERRYRERKLQYGDSKDNPLKYWLYKEEGERRHRKPREPDRDKKHREKSSTREKREKYSKEKSNSFSDKGEERHKEKRHKEGFHFDDERHQSNVDRKEKSAKDEPRKREFQNGEHRNRGASSKRDGTSSQHAENLVRNHGKDKDSRRKHGHEEGSSVWWKLDQRPGGEETVEIEKEETDLENARADAYTASCEDDFEDYEDDFEVCDGDDDESSNEPESREKLEELPLAQKKEIQEIQRAINAENERIGELSLKLFQKRGRTEFEKEPRTDTNSSPSRASVCGIFVDFASASHRQKSRTQALKQKMRSTKLLRLIDLDFSFTFSLLDLPPVNEYDMYIRNFGKKNTKQAYVQCNEDNVERDIQTEEIETREVWTQHPGESTVVSGGSEQRDTSDAVVMPKIDTPRLCSFLRAACQVMAVLLEEDRLAAEPSWNLRAQDRALYFSDSSSQLNTSLPFLQNRKVSSLHTSRVQRQMVVSVHDLPEKSFVPLLDSKYVLCVWDIWQPSGPQKVLICESQVTCCCLSPLKAFLLFAGTAHGSVVVWDLREDSRLHYSVTLSDGFWTFRTATFSTDGILTSVNHRSPLQAVEPISTSVHKKQSFVLSPFSTQEEMSGLSFHIASLDESGVLNVWVVVELPKADIAGSISDLGLMPGGRVKLVHSALIQLGDSLSHKGNEFWGTTQTLNVKFLPSDPNHFIIGTDMGLISHGTRQDLRVAPKLFKPQQHGIRPVKVNVIDFSPFGEPIFLAGCSDGSIRLHQLSSAFPLLQWDSSTDSHAVTGLQWSPTRPAVFLVQDDTSNIYIWDLLQSDLGPVAKQQVSPNRLVAMAAVGEPEKAGGSFLALVLARASGSIDIQHLKRRWAAPEVDECNRLRLLLQEALWPEGKLHK

SEQ ID NO: 3326 - protein, 389 aa, Homo sapiens
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGFRESAFSFSMLAAGVMHAVATACSLGKLVSCGCGWKGSGEQDRLRAKLLQLQALSRGKSFPHSLPSPGPGSSPSPGPQDTWEWGGCNHDMDFGEKFSRDFLDSREAPRDIQARMRIHNNRVGRQVVTENLKRKCKCHGTSGSCQFKTCWRAAPEFRAVGAALRERLGRAIFIDTHNRNSGAFQPRLRPRRLSGELVYFEKSPDFCERDPTMGSPGTRGRACNKTSRLLDGCGSLCCGRGHNVLRQTRVERCHCRFHWCCYVLCDECKVTEWVNVCK

SEQ ID NO: 3327 - protein, 626 aa, Homo sapiens
MASPSPPPESKGLLTFEDVAVFFTQEEWDYLDPAQRSLYKDVMMENYGNLVSLDVLNRDKDEEPTVKQEIEEIEEEVEPQGVIVTRIKSEIDQDPMGRETFELVGRLDKQRGIFLWEIPRESLTQEQRMFRENTNIIRKRPNSEEKCHKCEECGKGFVRKAHFIQHQRVHTGEKPFQCNECGKSFSRSSFVIEHQRIHTGERPYECNYCGKTFSVSSTLIRHQRIHTGERPYQCNQCKQSFSQRRSLVKHQRIHTGEKPHKCSDCGKAFSWKSHLIEHQRTHTGEKPYHCTKCKKSFSRNSLLVEHQRIHTGERPHKCGECGKAFRLSTYLIQHQKIHTGEKPFLCIECGKSFSRSSFLIEHQRIHTGERPYQCKECGKSFSQLCNLTRHQRIHTGDKPHKCEECGKAFSRSSGLIQHQRIHTREKTYPYNETKESFDPNCSLVIQQEVYPKEKSYKCDECGKTFSVSAHLVQHQRIHTGEKPYLCTVCGKSFSRSSFLIEHQRIHTGERPYLCRQCGKSFSQLCNLIRHQGVHTGNKPHKCDECGKAFSRNSGLIQHQRIHTGEKPYKCEKCDKSFSQQRSLVNHQKIHAEVKTQETHECDACGEAFNCRISLIQHQKLHTAWMQ

SEQ ID NO: 3328 - protein, 584 aa, Homo sapiens
MMENYGNLVSLDVLNRDKDEEPTVKQEIEEIEEEVEPQGVIVTRIKSEIDQDPMGRETFELVGRLDKQRGIFLWEIPRESLTQEQRMFRENTNIIRKRPNSEEKCHKCEECGKGFVRKAHFIQHQRVHTGEKPFQCNECGKSFSRSSFVIEHQRIHTGERPYECNYCGKTFSVSSTLIRHQRIHTGERPYQCNQCKQSFSQRRSLVKHQRIHTGEKPHKCSDCGKAFSWKSHLIEHQRTHTGEKPYHCTKCKKSFSRNSLLVEHQRIHTGERPHKCGECGKAFRLSTYLIQHQKIHTGEKPFLCIECGKSFSRSSFLIEHQRIHTGERPYQCKECGKSFSQLCNLTRHQRIHTGDKPHKCEECGKAFSRSSGLIQHQRIHTREKTYPYNETKESFDPNCSLVIQQEVYPKEKSYKCDECGKTFSVSAHLVQHQRIHTGEKPYLCTVCGKSFSRSSFLIEHQRIHTGERPYLCRQCGKSFSQLCNLIRHQGVHTGNKPHKCDECGKAFSRNSGLIQHQRIHTGEKPYKCEKCDKSFSQQRSLVNHQKIHAEVKTQETHECDACGEAFNCRISLIQHQKLHTAWMQ

SEQ ID NO: 3329 - protein, 459 aa, Homo sapiens
MASSASLETMVPPACPRAGASPATSKTLAFSIERIMAKTSEPRAPFEPRPGALEADGSQGKKLLNLCSPLPCMIPLQPLGYEVPSKTLLSYSELWKSSLRAGGGGGGGGGGGGGGGGAPVCGASGLCKTNCGVCCKAELGLAPSALPAGRVIKPQVINQAVGLTASGSLYYFNYLDSTAYPPSELLSGHLFPSGLLNAQAPAALAAHPKLFLLENAKLAGLAADKFPHPAPYPHKERLPAPLEQVLKENWALTAERGGVKGHSKLPGGSADGKPKNFTCEVCGKVFNAHYNLTRHMPVHTGARPFVCKVCGKGFRQASTLCRHKIIHTQEKPHKCNQCGKAFNRSSTLNTHIRIHAGYKPFVCEFCGKGFHQKGNYKNHKLTHSGEKQYKCTICNKAFHQVYNLTFHMHTHNDKKPFTCATCGKGFCRNFDLKKHVRKLHDSVGPAAPSAKDLTRTVQS

SEQ ID NO: 3330 - protein, 540 aa, Homo sapiens
MELLTFRDVAIEFSPEEWKCLDPAQQNLYRDVMLENYRNLVSLAVYSYYNQGILPEQGIQDSFKKATLGRYGSCGLENICLWKNWESIGEGEGQKECYNLCSQYLTTSHNKHLTVKGDKEYRIFQKKPQFLSAAPTEPCIPMNKYQHKFLKSVFCNKNQINFNHDSDISKHHSTHFLENYYNCNECEKVFYQSSKLIFPENIHIQEKPYNSNECGETSDPFSKLTQHQRIYIGESSQRCNKKCIIVFSQSHLKGHKIINTGEKSVKYKERGKAFTRGLHLGHQKIHTGEKPYKCKKCDKAFNKSSHLAQHQRIHTGEKPFKCKECGKAFNRGSYLTQHQRIHTGERAFKCEECGKAFNRGSYLTQHQRIHTGEKPFRCKECGKAFNRSSYVTQHQRMHTGEKPFKCKECGKAFNRASHLTQHQRIHTGEKHFKCKECGKAFNRGSHLTRHQRIHTGEKSFKCEECGKAFIWGSHLTQHQRVHTGEKFFKCKECGKAFTRSSHLTQHQRIHTGEKPFKCKECGKAFNRRSTLTQHQIIHTR

SEQ ID NO: 3331 - protein, 377 aa, Homo sapiens
MKPAQRNLYRDVMLENYSNLVTVGCQVTKPDVIFKLEQEEEPWVMEEEMFGRHCPEVWEVDEQVKKQQETLVRKVTSISKKILIKEKVIECKKVAKIFPLSSDIVTSRQSFYDCDSLDKGLEHNLDLLRYEKGCVREKQSNEFGKPFYHCASYVVTPFKCNQCGQDFSHKFDLIRHERIHAGEKPYECKECGKAFSRKENLITHQKIHTGEKPYKCNECGKAFIQMSNLIRHHRIHTGEKPYACKDCWKAFSQKSNLIEHERIHTGEKPYECKECGKSFSQKQNLIEHEKIHTGEKPYACNECGRAFSRMSSVTLHMRSHTGEKPYKCNKCGKAFSQCSVFIIHMRSHTGEKPYVCSECGKAFSQSSSLTVHAKSYS

SEQ ID NO: 3332 - protein, 465 aa, Homo sapiens
MALPQGLLTFRDVAIEFSQEEWKCLDPAQRTLYRDVMLENYRNLVSLDTSSKCMMKMFSSTGQGNTEVVHTGTLQIHASHHIGDTCFQEIEKDIHDFVFQWQENETNGHEALMTKIKKLMSSTERHDQRHAGNKPIKNELGSSFHSHLPEVHIFHPEGKIGNQVEKAINDAFSVSASQRISCRPKTRISNKYRNNFLQSSLLTQKREVHTREKSFQRNESGKAFNGSSLLKKHQIIHLGDKQYKCDVCGKDFHQKRYLACHRCHTGENPYKCNECGKTFSHNSALLVHKAIHTGEKPYKCNECGKVFNQQSNLARHHRVHTGEKPYKCEECDKVFSRKSHLERHRRIHTGEKPYKCKVCDKAFRRDSHLAQHTVIHTGEKPYKCNECGKTFVQNSSLVMHKVIHTGEKRYKCNECGKVFNHKSNLACHHRLHTGEKPYKCNECGKVFNRKSNLERHHRLHTGKKS

SEQ ID NO: 3333 - protein, 122 aa, Homo sapiens
MPANEDAPQPGEHGSACEVSVSFEDVTVDFSREEWQQLDSTQRRLYQDVMLENYSHLLSVGFEVPKPEVIFKLEQGEGPWTLEGEAPHQSCSDGKFGIKPSQRRISGKSTFHSEMEGEDTLC

SEQ ID NO: 3334 - protein, 1426 aa, Homo sapiens [sequence omitted]

SEQ ID NO: 3335 - protein, 1426 aa, Homo sapiens [sequence omitted]

SEQ ID NO: 3336 - DNA, 17 bp, Homo sapiens
gatctgcttaaagccag

SEQ ID NO: 3337 - DNA, 17 bp, Homo sapiens
gatctggccagttgttc

SEQ ID NO: 3338 - DNA, 17 bp, Homo sapiens
gatcttgtatgctcctg

SEQ ID NO: 3339 - DNA, 17 bp, Homo sapiens
gatctgtgctgtgtggg

SEQ ID NO: 3340 - DNA, 17 bp, Homo sapiens
gatctcaggaaagtcac

SEQ ID NO: 3341 - DNA, 17 bp, Homo sapiens
gatccaatcaaaggccc

SEQ ID NO: 3342 - DNA, 17 bp, Homo sapiens
gatcacctgtgtatctt

SEQ ID NO: 3343 - DNA, 17 bp, Homo sapiens
gatcgtaggctttttag

SEQ ID NO: 3344 - DNA, 17 bp, Homo sapiens
gatctctcttcaagttc

SEQ ID NO: 3345 - DNA, 17 bp, Homo sapiens
gatccttatcaccattc

SEQ ID NO: 3346 - DNA, 17 bp, Homo sapiens
gatcctgataaacactg

SEQ ID NO: 3347 - DNA, 17 bp, Homo sapiens
gatcaaatttaatgtgg

SEQ ID NO: 3348 - DNA, 17 bp, Homo sapiens
gatcatcactgtctatg

SEQ ID NO: 3349 - DNA, 17 bp, Homo sapiens
gatctacaggaaagaag

SEQ ID NO: 3350 - DNA, 17 bp, Homo sapiens
gatccattttgtgttaa

SEQ ID NO: 3351 - DNA, 17 bp, Homo sapiens
gatcggaatggaaacca

SEQ ID NO: 3352 - DNA, 17 bp, Homo sapiens
gatcgctcagggctcac

SEQ ID NO: 3353 - DNA, 17 bp, Homo sapiens
gatcttatcactttctg

SEQ ID NO: 3354 - DNA, 17 bp, Homo sapiens
gatcataaattaaaaat

SEQ ID NO: 3355 - DNA, 17 bp, Homo sapiens
gatccccccttccagcc

SEQ ID NO: 3356 - DNA, 17 bp, Homo sapiens
gatcaaaatattttaat

SEQ ID NO: 3357 - DNA, 17 bp, Homo sapiens
gatccagcaattgtaca

SEQ ID NO: 3358 - DNA, 17 bp, Homo sapiens
gatctgcacaggaagat

SEQ ID NO: 3359 - DNA, 17 bp, Homo sapiens
gatccgccatcagtacc

SEQ ID NO: 3360 - DNA, 17 bp, Homo sapiens
gatcagccatacctttg

SEQ ID NO: 3361 - DNA, 17 bp, Homo sapiens
gatctcaggccttccac

SEQ ID NO: 3362 - DNA, 17 bp, Homo sapiens
gatcccaagacagtcta

SEQ ID NO: 3363 - DNA, 17 bp, Homo sapiens
gatcatgaaaacatcag

SEQ ID NO: 3364 - DNA, 17 bp, Homo sapiens
gatccccataaaagcct

SEQ ID NO: 3365 - DNA, 17 bp, Homo sapiens
gatcaacctagaggtgg

SEQ ID NO: 3366 - DNA, 17 bp, Homo sapiens
gatcctcacagctgccc

SEQ ID NO: 3367 - DNA, 17 bp, Homo sapiens
gatcatcaaaaatatat

SEQ ID NO: 3368 - DNA, 17 bp, Homo sapiens
gatcctgtttttgtttg

SEQ ID NO: 3369 - DNA, 17 bp, Homo sapiens
gatcttccatgggaaga

SEQ ID NO: 3370 - DNA, 17 bp, Homo sapiens
gatctgcagattggaga

SEQ ID NO: 3371 - DNA, 17 bp, Homo sapiens
gatcatcttcttattta

SEQ ID NO: 3372 - DNA, 17 bp, Homo sapiens
gatcctcattgaccggg

SEQ ID NO: 3373 - DNA, 17 bp, Homo sapiens
gatcttaaattatgtta

SEQ ID NO: 3374 - DNA, 17 bp, Homo sapiens
gatcatttgaaagttgt

SEQ ID NO: 3375 - DNA, 17 bp, Homo sapiens
gatctcgatatttcaga

SEQ ID NO: 3376 - DNA, 17 bp, Homo sapiens
gatcagatggaaacaat

SEQ ID NO: 3377 - DNA, 17 bp, Homo sapiens
gatctcttgcctcctag

SEQ ID NO: 3378 - DNA, 17 bp, Homo sapiens
gatcgcgtcactacact

SEQ ID NO: 3379 - DNA, 17 bp, Homo sapiens
gatctatggttaaatcc

SEQ ID NO: 3380 - DNA, 17 bp, Homo sapiens
gatctacttaccctccg

SEQ ID NO: 3381 - DNA, 17 bp, Homo sapiens
gatcatatttcatctac

SEQ ID NO: 3382 - DNA, 17 bp, Homo sapiens
gatcacttgtgcaaata

SEQ ID NO: 3383 - DNA, 17 bp, Homo sapiens
gatccctttaagaaaaa

SEQ ID NO: 3384 - DNA, 17 bp, Homo sapiens
gatctccagaactagac

SEQ ID NO: 3385 - DNA, 17 bp, Homo sapiens
gatcccaccctcctcag

SEQ ID NO: 3386 - DNA, 17 bp, Homo sapiens
gatctgttcactactgg

SEQ ID NO: 3387 - DNA, 17 bp, Homo sapiens
gatctagcaagagatag

SEQ ID NO: 3388 - DNA, 17 bp, Homo sapiens
gatcttgtctatggtct

SEQ ID NO: 3389 - DNA, 17 bp, Homo sapiens
gatcatgccatccccca

SEQ ID NO: 3390 - DNA, 17 bp, Homo sapiens
gatccgtttacactttt

SEQ ID NO: 3391 - DNA, 17 bp, Homo sapiens
gatcattgttgtttcat

SEQ ID NO: 3392 - DNA, 17 bp, Homo sapiens
gatccaaaggagaaaat

SEQ ID NO: 3393 - DNA, 17 bp, Homo sapiens
gatctagcatctggttc

SEQ ID NO: 3394 - DNA, 17 bp, Homo sapiens
gatccctcgctctctcc

SEQ ID NO: 3395 - DNA, 17 bp, Homo sapiens
gatcaacagacctaaga

SEQ ID NO: 3396 - DNA, 17 bp, Homo sapiens
gatctgcattttgttgg

SEQ ID NO: 3397 - DNA, 17 bp, Homo sapiens
gatcctgtttgtgttgt

SEQ ID NO: 3398 - DNA, 17 bp, Homo sapiens
gatcatataacttaatt

SEQ ID NO: 3399 - DNA, 17 bp, Homo sapiens
gatccagatacagtgga

SEQ ID NO: 3400 - DNA, 17 bp, Homo sapiens
gatcatctttaaagggc

SEQ ID NO: 3401 - DNA, 17 bp, Homo sapiens
gatccttcacctgtcca

SEQ ID NO: 3402 - DNA, 17 bp, Homo sapiens
gatcagaacacgacttg

SEQ ID NO: 3403 - DNA, 17 bp, Homo sapiens
gatcctatagctgtttt

SEQ ID NO: 3404 - DNA, 17 bp, Homo sapiens
gatcttttcagtagcca

SEQ ID NO: 3405 - DNA, 17 bp, Homo sapiens
gatctttttctttaaaa

SEQ ID NO: 3406 - DNA, 17 bp, Homo sapiens
gatcctgcatttccata

SEQ ID NO: 3407 - DNA, 17 bp, Homo sapiens
gatcccacatgtatttt

SEQ ID NO: 3408 - DNA, 17 bp, Homo sapiens
gatctggtctctaaaaa

SEQ ID NO: 3409 - DNA, 17 bp, Homo sapiens
gatctcagatgaaggca

SEQ ID NO: 3410 - DNA, 17 bp, Homo sapiens
gatccaggtttctggca

SEQ ID NO: 3411 - DNA, 17 bp, Homo sapiens
gatctcttgttgacagt

SEQ ID NO: 3412 - DNA, 17 bp, Homo sapiens
gatctgagattgtcttt

SEQ ID NO: 3413 - DNA, 17 bp, Homo sapiens
gatccatccatattgct

SEQ ID NO: 3414 - DNA, 17 bp, Homo sapiens
gatctttgctgtgctct

SEQ ID NO: 3415 - DNA, 17 bp, Homo sapiens
gatcagaatcaaggtca

SEQ ID NO: 3416 - DNA, 17 bp, Homo sapiens
gatctctgtttctcgca

SEQ ID NO: 3417 - DNA, 17 bp, Homo sapiens
gatcatacacaagttta

SEQ ID NO: 3418 - DNA, 17 bp, Homo sapiens
gatctctctacagcggg

SEQ ID NO: 3419 - DNA, 17 bp, Homo sapiens
gatcccatgaacccagg

SEQ ID NO: 3420 - DNA, 17 bp, Homo sapiens
gatcttctcctcaaaca

SEQ ID NO: 3421 - DNA, 17 bp, Homo sapiens
gatccattgcttcgagg

SEQ ID NO: 3422 - DNA, 17 bp, Homo sapiens
gatccgggtatagggaa

SEQ ID NO: 3423 - DNA, 17 bp, Homo sapiens
gatcttcttttaatatc

SEQ ID NO: 3424 - DNA, 17 bp, Homo sapiens
gatctgaataaatcata

SEQ ID NO: 3425 - DNA, 17 bp, Homo sapiens
gatcccaaagaaaggag

SEQ ID NO: 3426 - DNA, 17 bp, Homo sapiens
gatcacagtgtcaggaa

SEQ ID NO: 3427 - DNA, 17 bp, Homo sapiens
gatcagcagagccatca

SEQ ID NO: 3428 - DNA, 17 bp, Homo sapiens
gatcaaaatattcctct

SEQ ID NO: 3429 - DNA, 17 bp, Homo sapiens
gatcctagacatgtata

SEQ ID NO: 3430 - DNA, 17 bp, Homo sapiens
gatcaggtgtgttgctg

SEQ ID NO: 3431 - DNA, 17 bp, Homo sapiens
gatcagtttgattttgt

SEQ ID NO: 3432 - DNA, 17 bp, Homo sapiens
gatcgcatcttgtttag

SEQ ID NO: 3433 - DNA, 17 bp, Homo sapiens
gatcggttatctctctt

SEQ ID NO: 3434 - DNA, 17 bp, Homo sapiens
gatctttcttcacgctg

SEQ ID NO: 3435 - DNA, 17 bp, Homo sapiens
gatctacataaagaaag

SEQ ID NO: 3436 - DNA, 17 bp, Homo sapiens
gatcctgggagcacttc

SEQ ID NO: 3437 - DNA, 17 bp, Homo sapiens
gatctgtctctgtattc

SEQ ID NO: 3438 - DNA, 17 bp, Homo sapiens
gatcaaattctcctggg

SEQ ID NO: 3439 - DNA, 17 bp, Homo sapiens
gatcgcttctctgcttg

SEQ ID NO: 3440 - DNA, 17 bp, Homo sapiens
gatcgtaccccacagcc

SEQ ID NO: 3441 - DNA, 17 bp, Homo sapiens
gatctgtctcaactccc

SEQ ID NO: 3442 - DNA, 17 bp, Homo sapiens
gatctgaaagataagaa

SEQ ID NO: 3443 - DNA, 17 bp, Homo sapiens
gatctttggactctcgt

SEQ ID NO: 3444 - DNA, 17 bp, Homo sapiens
gatctcaagaaatagaa

SEQ ID NO: 3445 - DNA, 17 bp, Homo sapiens
gatcgttcttcatttga

SEQ ID NO: 3446 - DNA, 17 bp, Homo sapiens
gatcccattcctgtgtc

SEQ ID NO: 3447 - DNA, 17 bp, Homo sapiens
gatcatgcaaaataaac

SEQ ID NO: 3448 - DNA, 17 bp, Homo sapiens
gatccttccccagaact

SEQ ID NO: 3449 - DNA, 17 bp, Homo sapiens
gatccttattttcgttt

SEQ ID NO: 3450 - DNA, 17 bp, Homo sapiens
gatcttcttaaagccca

SEQ ID NO: 3451 - DNA, 17 bp, Homo sapiens
gatccaaatggtttggg

SEQ ID NO: 3452 - DNA, 17 bp, Homo sapiens
gatctctaagtaattct

SEQ ID NO: 3453 - DNA, 17 bp, Homo sapiens
gatcctgtacaattgca

SEQ ID NO: 3454 - DNA, 17 bp, Homo sapiens
gatcacctatttctggt

SEQ ID NO: 3455 - DNA, 17 bp, Homo sapiens
gatcattcacacatgtg

SEQ ID NO: 3456 - DNA, 17 bp, Homo sapiens
gatcagaaaaactagaa

SEQ ID NO: 3457 - DNA, 17 bp, Homo sapiens
gatcctatcacccactc

SEQ ID NO: 3458 - DNA, 17 bp, Homo sapiens
gatccattatttgcaaa

SEQ ID NO: 3459 - DNA, 17 bp, Homo sapiens
gatcagccatagccaag

SEQ ID NO: 3460 - DNA, 17 bp, Homo sapiens
gatctaatagtcttttc

SEQ ID NO: 3461 - DNA, 17 bp, Homo sapiens
gatcttaccttcccaat

SEQ ID NO: 3462 - DNA, 17 bp, Homo sapiens
gatcatttttcacaggc

SEQ ID NO: 3463 - DNA, 17 bp, Homo sapiens
gatccttgagttaccaa

SEQ ID NO: 3464 - DNA, 17 bp, Homo sapiens
gatcaacaaatcacata

SEQ ID NO: 3465 - DNA, 17 bp, Homo sapiens
gatcatcattggctgct

SEQ ID NO: 3466 - DNA, 17 bp, Homo sapiens
gatctaaagcagacaaa

SEQ ID NO: 3467 - DNA, 17 bp, Homo sapiens
gatctatgttcctgtct

SEQ ID NO: 3468 - DNA, 17 bp, Homo sapiens
gatcaccttaaccagaa

SEQ ID NO: 3469 - DNA, 17 bp, Homo sapiens
gatccagttgctaaaga

SEQ ID NO: 3470 - DNA, 17 bp, Homo sapiens
gatcaactgtaataatc

SEQ ID NO: 3471 - DNA, 17 bp, Homo sapiens
gatctgtgatataaata

SEQ ID NO: 3472 - DNA, 17 bp, Homo sapiens
gatctgtccacatttgg

SEQ ID NO: 3473 - DNA, 17 bp, Homo sapiens
gatccggataaggacaa

SEQ ID NO: 3474 - DNA, 17 bp, Homo sapiens
gatccctcctgaaaagt

SEQ ID NO: 3475 - DNA, 17 bp, Homo sapiens
gatcactacccatttcg

SEQ ID NO: 3476 - DNA, 17 bp, Homo sapiens
gatcccatttgtaaaga

SEQ ID NO: 3477 - DNA, 17 bp, Homo sapiens
gatcctcacctgtggtt

SEQ ID NO: 3478 - DNA, 17 bp, Homo sapiens
gatctttcattcaatga

SEQ ID NO: 3479 - DNA, 17 bp, Homo sapiens
gatctgaggatttttca

SEQ ID NO: 3480 - DNA, 17 bp, Homo sapiens
gatcgcccagctggagg

SEQ ID NO: 3481 - DNA, 17 bp, Homo sapiens
gatcatttttgcctcat

SEQ ID NO: 3482 - DNA, 17 bp, Homo sapiens
gatctactctctcagaa

SEQ ID NO: 3483 - DNA, 17 bp, Homo sapiens
gatcatatcaatcatat

SEQ ID NO: 3484 - DNA, 17 bp, Homo sapiens
gatcaacaaattagaaa

SEQ ID NO: 3485 - DNA, 17 bp, Homo sapiens
gatctcggaactttcag

SEQ ID NO: 3486 - DNA, 17 bp, Homo sapiens
gatcctgatgaatgaag

SEQ ID NO: 3487 - DNA, 17 bp, Homo sapiens
gatcaaaagctgaaaca

SEQ ID NO: 3488 - DNA, 17 bp, Homo sapiens
gatccatttgaaaataa

SEQ ID NO: 3489 - DNA, 17 bp, Homo sapiens
gatcaggattggaaaaa

SEQ ID NO: 3490 - DNA, 17 bp, Homo sapiens
gatcatatcatttgatt

SEQ ID NO: 3491 - DNA, 17 bp, Homo sapiens
gatcatcggagtagaat

SEQ ID NO: 3492 - DNA, 17 bp, Homo sapiens
gatcctttattttaaaa

SEQ ID NO: 3493 - DNA, 17 bp, Homo sapiens
gatcctggttgtattca

SEQ ID NO: 3494 - DNA, 17 bp, Homo sapiens
gatcctgcggtgatact

SEQ ID NO: 3495 - DNA, 17 bp, Homo sapiens
gatctttttatttttat

SEQ ID NO: 3496 - DNA, 17 bp, Homo sapiens
gatctctatcaaaataa

SEQ ID NO: 3497 - DNA, 17 bp, Homo sapiens
gatcagctgccaacatt

SEQ ID NO: 3498 - DNA, 17 bp, Homo sapiens
gatctgggaaaaggaag

SEQ ID NO: 3499 - DNA, 17 bp, Homo sapiens
gatcactgagcatttct

SEQ ID NO: 3500 - DNA, 17 bp, Homo sapiens
gatcaggttctccttgt

SEQ ID NO: 3501 - DNA, 17 bp, Homo sapiens
gatcaattcagttagct

SEQ ID NO: 3502 - DNA, 17 bp, Homo sapiens
gatccaggagaggaata

SEQ ID NO: 3503 - DNA, 17 bp, Homo sapiens
gatctctcatttgtttt

SEQ ID NO: 3504 - DNA, 17 bp, Homo sapiens
gatcgggaattacaata

SEQ ID NO: 3505 - DNA, 17 bp, Homo sapiens
gatcctagaagttcgag

SEQ ID NO: 3506 - DNA, 17 bp, Homo sapiens
gatcctgaatggaataa

SEQ ID NO: 3507 - DNA, 17 bp, Homo sapiens
gatctcctgccaacact

SEQ ID NO: 3508 - DNA, 17 bp, Homo sapiens
gatcaaaacatatttaa

SEQ ID NO: 3509 - DNA, 17 bp, Homo sapiens
gatcccctctcttcaaa

SEQ ID NO: 3510 - DNA, 17 bp, Homo sapiens
gatccccattttaccat

SEQ ID NO: 3511 - DNA, 17 bp, Homo sapiens
gatcatcagctccatga

SEQ ID NO: 3512 - DNA, 17 bp, Homo sapiens
gatcaagctacagcaca

SEQ ID NO: 3513 - DNA, 17 bp, Homo sapiens
gatcacggaatctcctt

SEQ ID NO: 3514 - DNA, 17 bp, Homo sapiens
gatcttcacagccctct

SEQ ID NO: 3515 - DNA, 17 bp, Homo sapiens
gatccagccctggtggt

SEQ ID NO: 3516 - DNA, 17 bp, Homo sapiens
gatctcctgtgaacttt

SEQ ID NO: 3517 - DNA, 17 bp, Homo sapiens
gatctcccataatattt

SEQ ID NO: 3518 - DNA, 17 bp, Homo sapiens
gatcttctcttttgcta

SEQ ID NO: 3519 - DNA, 17 bp, Homo sapiens
gatccactgccgtgtcc

SEQ ID NO: 3520 - DNA, 17 bp, Homo sapiens
gatcatccttgaagtac

SEQ ID NO: 3521 - DNA, 17 bp, Homo sapiens
gatcacttttttctttt

SEQ ID NO: 3522 - DNA, 17 bp, Homo sapiens
gatctatcagttcattt

SEQ ID NO: 3523 - DNA, 17 bp, Homo sapiens
gatcacaaaaactcaat

SEQ ID NO: 3524 - DNA, 17 bp, Homo sapiens
gatcagagaaaaaccgt

SEQ ID NO: 3525 - DNA, 17 bp, Homo sapiens
gatcagatgatacagga

SEQ ID NO: 3526 - DNA, 17 bp, Homo sapiens
gatccagctcaatgaga

SEQ ID NO: 3527 - DNA, 17 bp, Homo sapiens
gatcagcttccccgcgg

SEQ ID NO: 3528 - DNA, 17 bp, Homo sapiens
gatcatcatctcccatt

SEQ ID NO: 3529 - DNA, 17 bp, Homo sapiens
gatcagaaagttttaac

SEQ ID NO: 3530 - DNA, 17 bp, Homo sapiens
gatcctcccacatcggc

SEQ ID NO: 3531 - DNA, 17 bp, Homo sapiens
gatccagaggatggaga

SEQ ID NO: 3532 - DNA, 17 bp, Homo sapiens
gatcaaatttattttca

SEQ ID NO: 3533 - DNA, 17 bp, Homo sapiens
gatctacttggggattc

SEQ ID NO: 3534 - DNA, 17 bp, Homo sapiens
gatcaaacttcggcact

SEQ ID NO: 3535 - DNA, 17 bp, Homo sapiens
gatctacactttagaaa

SEQ ID NO: 3536 - DNA, 17 bp, Homo sapiens
gatcaacagtgacctca

SEQ ID NO: 3537 - DNA, 17 bp, Homo sapiens
gatcaaattcatttaat

SEQ ID NO: 3538 - DNA, 17 bp, Homo sapiens
gatctatgtattttgaa

SEQ ID NO: 3539 - DNA, 17 bp, Homo sapiens
gatcccaaaacagagtt

SEQ ID NO: 3540 - DNA, 17 bp, Homo sapiens
gatcgctgagagggagg

SEQ ID NO: 3541 - DNA, 17 bp, Homo sapiens
gatcttgaagaatgagc

SEQ ID NO: 3542 - DNA, 17 bp, Homo sapiens
gatctttcttttttgtt

SEQ ID NO: 3543 - DNA, 17 bp, Homo sapiens
gatccagaagtaagctc

SEQ ID NO: 3544 - DNA, 17 bp, Homo sapiens
gatccttccaaaaggcc

SEQ ID NO: 3545 - DNA, 17 bp, Homo sapiens
gatctaaggcacaaata

SEQ ID NO: 3546 - DNA, 17 bp, Homo sapiens
gatctagctgtggcttt

SEQ ID NO: 3547 - DNA, 17 bp, Homo sapiens
gatcctatacagtaaca

SEQ ID NO: 3548 - DNA, 17 bp, Homo sapiens
gatcacacatagtagga

SEQ ID NO: 3549 - DNA, 17 bp, Homo sapiens
gatcacagaagtgaatg

SEQ ID NO: 3550 - DNA, 17 bp, Homo sapiens
gatctccacttcattca

SEQ ID NO: 3551 - DNA, 17 bp, Homo sapiens
gatcagtgtaaaaatcg

SEQ ID NO: 3552 - DNA, 17 bp, Homo sapiens
gatcagctgctgtttct

SEQ ID NO: 3553 - DNA, 17 bp, Homo sapiens
gatctgtgatatttctc

SEQ ID NO: 3554 - DNA, 17 bp, Homo sapiens
gatcttgacaactgtgc

SEQ ID NO: 3555 - DNA, 17 bp, Homo sapiens
gatcatctgaaatgccc

SEQ ID NO: 3556 - DNA, 17 bp, Homo sapiens
gatctttgcctcgttca

SEQ ID NO: 3557 - DNA, 17 bp, Homo sapiens
gatctgctctctgaata

SEQ ID NO: 3558 - DNA, 17 bp, Homo sapiens
gatcttgaactaatcct

SEQ ID NO: 3559 - DNA, 17 bp, Homo sapiens
gatcagaaaaaagtttg

SEQ ID NO: 3560 - DNA, 17 bp, Homo sapiens
gatcttgttacatttgc

SEQ ID NO: 3561 - DNA, 17 bp, Homo sapiens
gatcagttcactgtatt

SEQ ID NO: 3562 - DNA, 17 bp, Homo sapiens
gatcctgcctttggtgt

SEQ ID NO: 3563 - DNA, 17 bp, Homo sapiens
gatcccatttagaacca

SEQ ID NO: 3564 - DNA, 17 bp, Homo sapiens
gatctcattcaagaatt

SEQ ID NO: 3565 - DNA, 17 bp, Homo sapiens
gatctaccctatgtctt

SEQ ID NO: 3566 - DNA, 17 bp, Homo sapiens
gatctacactggccatg

SEQ ID NO: 3567 - DNA, 17 bp, Homo sapiens
gatcaggcccaagaatt

SEQ ID NO: 3568 - DNA, 17 bp, Homo sapiens
gatcaacaaaggaatat

SEQ ID NO: 3569 - DNA, 17 bp, Homo sapiens
gatccagttgggtgaca

SEQ ID NO: 3570 - DNA, 17 bp, Homo sapiens
gatcacccactcctatg

SEQ ID NO: 3571 - DNA, 17 bp, Homo sapiens
gatcctacgagatgaga

SEQ ID NO: 3572 - DNA, 17 bp, Homo sapiens
gatcctctgatgttcaa

SEQ ID NO: 3573 - DNA, 17 bp, Homo sapiens
gatcacacatataaact

SEQ ID NO: 3574 - DNA, 17 bp, Homo sapiens
gatctctgaatcataag

SEQ ID NO: 3575 - DNA, 17 bp, Homo sapiens
gatcaatttggggaaag

SEQ ID NO: 3576 - DNA, 17 bp, Homo sapiens
gatctggggtgctagag

SEQ ID NO: 3577 - DNA, 17 bp, Homo sapiens
gatctggcccagggact

SEQ ID NO: 3578 - DNA, 17 bp, Homo sapiens
gatcaacatctgtgaaa

SEQ ID NO: 3579 - DNA, 17 bp, Homo sapiens
gatccagcaggtgtcac

SEQ ID NO: 3580 - DNA, 7044 bp, Homo sapiens
tttttgtatttttagtagagacagggtttcaccatgttggtcaggctggtctcaaactcctgacttcgtgatctgcccaccttggcctcccaaagtgctgggattacaggcgtgagccaccgcacccggtcagctattttctacatgcttcatttgcagtgtaatattggattgtatgagactttgggttttgtgttaatacctacagaaaatgttgatattttctcttagcaggctgtcaaccaggttaggttcaggtcataagtttctacccacattctttgaactgtagttgtcattttagtttatttttcaaaaacttttgcagtacctttttggtctgtcttgtgtgtgccttgcagtgaacagtctggatttggacagtggtctgtctgttagttcagtttctcaagcctttgtcacactaataggattggatttatgtatgtccagcttgggaattattacaggaattaaaaacaactttttagagtgctttcctgagctctctttctatttgttcccccttctactttttgcttccctgtggctgctgtttctatcctccagccagagagctagtgtttattttctccattgtgttacacacttgtgcagctgcaaccaccatatccagggcccaatggtaggaggtagagaagaaaagcaaaagggattggcctcatcctcttacaacgatagttccattgaatagagagaaaggttttcctgcctcagagtgttggctgcactaggcttttgttactgtagtctggccctgttaccatgggattgcttgcatgtggggatacaggagaattcagaaaagaaaaaaagatttgctatttctacattctccctgagcattaagacttcccttgcccattcctcaattcaaagctaaggcttcttctggagctgcctctgtgggcggttcgggagataccaaaggagaaaaagtaccactgttgatatggtggtatttcaaattctggtctaccctatttcacatgccttgtttacttttcagagctgacagattgctgctccatgcattctgtccagtttcctaagagagacagcttggagtatgcttaatccatcttacctgggactgaaacagctgcttattttgccgttaaaaattacatgcagtttactgcgtggctccgggtttgtttgtttgtttttcctctttaataggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttcaaagactccatgtcctatgaacttcgtttttttcctgatatgattccagtatcttctatttatatggattcaagagctggctgttcaaaatcatgtgaggctgctcagtactggtcctcaggtttcacagttttacaagcatccatagatgctgccattatacagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaaaaaaaataaaagaatttttaaagataatgggacttcatgatactgccttttggctttcctgggttcttctatatacaagtttaatttttcttatgtcccttcttatggcagtcattgcgacagcttctttgttatttcctcaaagtagcagcattgtgatatttctgctttttttcctttatggattatcatctgtattttttgctttaatgctgacacctctttttaaaaaatcaaaacatgtgggaatagttgaattttttgttactgtggcttttggatttattggccttatgataatcctcatagaaagttttcccaaatcgttagtgtggcttttcagtcctttctgtcactgtacttttgtgattggtattgcacaggtcatgcatttagaagattttaatgaaggtgcttcattttcaaatttgactgcaggcccatatcctctaattattacaattatcatgctcacacttaatagtatattctatgtcctcttggctgtctatcttgatcaagtcattccaggggaatttggcttacggagatcatctttatattttctgaagccttcatattggtcaaagagcaaaagaaattatgaggagttatcagagggcaatgttaatggaaatattagttttagtgaaattattgagccagtttcttcagaatttgtaggaaaagaagccataagaattagtggtattcagaagacatacagaaagaagggtgaaaatgtggaggctttgagaaatttgtcatttgacatatatgagggtcagattactgccttacttggccacagtggaacaggaaagagtacattgatgaatattctttgtggactctgcccaccttctgatgggtttgcatctatatatggacacagagtctcagaaatagatgaaatgtttgaagcaagaaaaatgattggcatttgtccacagttagatatacactttgatgttttgacagtagaagaaaatttatcaattttggcttcaatcaaagggataccagccaacaatataatacaagaagtgcagaaggttttactagatttagacatgcagactatcaaagataaccaagctaaaaaattaagtggtggtcaaaaaagaaagctgtcattaggaattgctgttcttgggaacccaaagatactgctgctagatgaaccaacagctggaatggacccctgttctcgacatattgtatggaatcttttaaaatacagaaaagccaatcgggtgacagtgttcagtactcatttcatggatgaagctgacattcttgcagataggaaagctgtgatatcacaaggaatgctgaaatgtgttggttcttcaatgttcctcaaaagtaaatgggggatcggctaccgcctgagcatgtacatagacaaatattgtgccacagaatctctttcttcactggttaaacaacatatacctggagctactttattacaacagaatgaccaacaacttgtgtatagcttgcctttcaaggacatggacaaattttcaggtttgttttctgccctagacagtcattcaaatttgggtgtcatttcttatggtgtttccatgacgactttggaagacgtatttttaaagctagaagttgaagcagaaattgaccaagcagattatagtgtatttactcagcagccactggaggaagaaatggattcaaaatcttttgatgaaatggaacagagcttacttattctttctgaaaccaaggctgctctagtgagcaccatgagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctgactcagatatcagtgatcttattagctttttcacaagccagaacataatggtgacgatgattaatgacagtgactatgtatccgtggctccccatagtgcggctttaaatgtgatgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtggcgagcaattcgaactgcatttaaaaacagaaagcgggctgctattctgaccactcactatatggaggaggcagaggctgtctgtgatcgagtagctatcatggtgtctgggcagttaagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtgaagctgcatgtttgtattgaagtatattgaactatatagtttgtatgtcatctttttcaccattcagaaacagtgcttctgaatttgtgatttaaaggaattgtaatagaatagttttatttttaagttatctttaagtttatgccatcttcttaaataagtacgtaatgttccaatctaaataaaaaactaattcataactaatgcatagaaaagatacataaagcaatgtgaaagtttcttgcttctcctttttaatttctaaaaaagccactttgaatggaagttgtcatccgtaaaagctgaagtgtaagcactaggaaatctcaatatagagatttgaggaaagttatatccactaggtggcagtcattgatcataataagtgaaatgagcccttgttctagtacatgattttaggcttaggtaattaggtatgtgaaattacatttctttaatttaaagtaaaattcagaaggttttagttattataattaaaggaagactgtgtgtagaatcttacgtaatagtctgattctttgactctgtggctagaatgacagttatctatggaggtggtagaattaagccataccttttccttcatcactcttggaacatataaattttttgtcatcttccttgcaaagggcacatttaattttgttcttgaataaaatattttattgggtaaaaaaaaaaa

SEQ ID NO: 3581 - DNA, 5939 bp, Homo sapiens
gcggccgcgccctcgcacagatcccagctgggtcacccgcactgagtcaacagactgagcgcgtccaggcctgacagctctgcggctcgggccctgaggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttcaaagactccatgtcctatgaacttcgtttttttcctgatatgattccagtatcttctatttatatggattcaagagctggctgttcaaaatcatgtgaggctgctcagtactggtcctcaggtttcacagttttacaagcatccatagatgctgccattatacagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaaaaaaaataaaagaatttttaaagataatgggacttcatgatactgccttttggctttcctgggttcttctatatacaagtttaatttttcttatgtcccttcttatggcagtcattgcgacagcttctttgttatttcctcaaagtagcagcattgtgatatttctgctttttttcctttatggattatcatctgtattttttgctttaatgctgacacctctttttaaaaaatcaaaacatgtgggaatagttgaattttttgttactgtggcttttggatttattggccttatgataatcctcatagaaagttttcccaaatcgttagtgtggcttttcagtcctttctgtcactgtacttttgtgattggtattgcacaggtcatgcatttagaagattttaatgaaggtgcttcattttcaaatttgactgcaggcccatatcctctaattattacaattatcatgctcacacttaatagtatattctatgtcctcttggctgtctatcttgatcaagtcattccaggggaatttggcttacggagatcatctttatattttctgaagccttcatattggtcaaagagcaaaagaaattatgaggagttatcagagggcaatgttaatggaaatattagttttagtgaaattattgagccagtttcttcagaatttgtaggaaaagaagccataagaattagtggtattcagaagacatacagaaagaagggtgaaaatgtggaggctttgagaaatttgtcatttgacatatatgagggtcagattactgccttacttggccacagtggaacaggaaagagtacattgatgaatattctttgtggactctgcccaccttctgatgggtttgcatctatatatggacacagagtctcagaaatagatgaaatgtttgaagcaagaaaaatgattggcatttgtccacagttagatatacactttgatgttttgacagtagaagaaaatttatcaattttggcttcaatcaaagggataccagccaacaatataatacaagaagtgcagaaggttttactagatttagacatgcagactatcaaagataaccaagctaaaaaattaagtggtggtcaaaaaagaaagctgtcattaggaattgctgttcttgggaacccaaagatactgctgctagatgaaccaacagctggaatggacccctgttctcgacatattgtatggaatcttttaaaatacagaaaagccaatcgggtgacagtgttcagtactcatttcatggatgaagctgacattcttgcagataggaaagctgtgatatcacaaggaatgctgaaatgtgttggttcttcaatgttcctcaaaagtaaatgggggatcggctaccgcctgagcatgtacatagacaaatattgtgccacagaatctctttcttcactggttaaacaacatatacctggagctactttattacaacagaatgaccaacaacttgtgtatagcttgcctttcaaggacatggacaaattttcaggtttgttttctgccctagacagtcattcaaatttgggtgtcatttcttatggtgtttccatgacgactttggaagacgtatttttaaagctagaagttgaagcagaaattgaccaagcagattatagtgtatttactcagcagccactggaggaagaaatggattcaaaatcttttgatgaaatggaacagagcttacttattctttctgaaaccaaggctgctctagtgagcaccatgagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctgactcagatatcagtgatcttattagctttttcacaagccagaacataatggtgacgatgattaatgacagtgactatgtatccgtggctccccatagtgcggctttaaatgtgatgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtggcgagcaattcgaactgcatttaaaaacagaaagcgggctgctattctgaccactcactatatggaggaggcagaggctgtctgtgatcgagtagctatcatggtgtctgggcagttaagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtgaagctgcatgtttgtattgaagtatattgaactatatagtttgtatgtcatctttttcaccattcagaaacagtgcttctgaatttgtgatttaaaggaattgtaatagaatagttttatttttaagttatctttaagtttatgccatcttcttaaataagtacgtaatgttccaatctaaataaaaaactaattcataactaatgcatagaaaagatacataaagcaatgtgaaagtttcttgcttctcctttttaatttctaaaaaagccactttgaatggaagttgtcatccgtaaaagctgaagtgtaagcactaggaaatctcaatatagagatttgaggaaagttatatccactaggtggcagtcattgatcataataagtgaaatgagcccttgttctagtacatgattttaggcttaggtaattaggtatgtgaaattacatttctttaatttaaagtaaaattcagaaggttttagttattataattaaaggaagactgtgtgtagaatcttacgtaatagtctgattctttgactctgtggctagaatgacagttatctatggaggtggtagaattaagccataccttttccttcatcactcttggaacatataaattttttgtcatcttccttgcaaagggcacatttaattttgttcttgaataaaatattttattgggtaaaaaaaaaaa

SEQ ID NO: 3582 - DNA, 7620 bp, Homo sapiens
gtcattgagctgatgtgcttttgcaaggggtctctttagaagtggtaggggcagggtcgagagaagaaggggatgcagaatctgtacatgaggaaggagccagagtcactcaggaaactcctcattcttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgtagaaaaaaaaaaaa

SEQ ID NO: 3583 - DNA, 7704 bp, Homo sapiens
gtcattgagctgatgtgcttttgcaaggggtctctttagaagtggtaggggcagggtcgagagaagaaggggatgcagaatctgtacatgaggaaggagccagagtcactcaggaaactcctcattcttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgtagaaaaaaaaaaaa

SEQ ID NO: 3584 - DNA, 7597 bp, Homo sapiens
gagacagtaaggagccaggggaacagagagaattgtggggcagcaccgctccttgggtccccactccccatttctcattgcttggaaatccatgccaagatgcctgccttccttggtctaaagtgtctggggaaattgtgcagctctgagaaaagcaaagtcacctcatctgagagaaccagtgccaggggctcgaacagaaagagactgattgttgaggaccggagggtctctgggacctccttcaccgctcataggcgtgccactatcactcatttgctgtatctctgtcccaaggactactgcccacgtgggcgtgtatgtaacagcgttgatccttttgtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgtagaaaaaaaaaaaa

SEQ ID NO: 3585 - DNA, 6850 bp, Homo sapiens
gaggagaggaggcgtgagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgtagaaaaaaaaaaaa

SEQ ID NO: 3586 - DNA, 2728 bp, Homo sapiens
atcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattacaaaaaaaaaaaaaaaa

SEQ ID NO: 3587 - DNA, 3127 bp, Homo sapiens
gccgggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagtaaaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaaggtgagtccacgggaagccctcaaggtgaaagctggtaccagagggctccaggggggcaggtgtagagttgagaaaacaaagcaattcatgcttcttgtggtctggactgaacttccagaacaaaagccaagggcaaaacattcatgtttcttggtgcccgcttgactgtggagttttggcttcatgtgaaaggtgattcttagaatcctgagctgtggtggcttcagtcctgcccctgcacctgacctggggagggaccctgagcaagtccctcttgagtctgtttcctcatttgtacagaggctatgatgagcagtagtaccagccccatcaggttgttgtgaagagcaaggaagt

SEQ ID NO: 3588 - DNA, 6466 bp, Homo sapiens
gccgggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccatttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcacgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagcctttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 3589 - DNA, 3606 bp, Homo sapiens
gacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgag

SEQ ID NO: 3590 - DNA, 12462 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaatgaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgaccatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaaccttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccacact

SEQ ID NO: 3591 - DNA, 6058 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagattgaagaactctctttagcttttcttgtcagacagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaatgaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgaccatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccaggtaagggtcttgtagtcccctttctctccccagttatttttttttccaaacaccaacttgaaccagatccccaattaaaacaacagtattttttatgtagccataatttttttttttttttgccgaaatctgaataaactacatatatttagcatcaggaacacactctatactaagacagcagctttagatcttgttagggacacctatctcaaccttggagtgggcattgtctttctgtcattttatttaactcctttttcaagcactggaaaagtggctacacggttttgtttttttcttttaaatcattccattagccatatatagcaaactcactttgacattttggaaataacattgtgctgaggtgctccattatgcagttactatcattcagttttactatcttcatttatagttttgtgagtccaccaattagcatctcgaaggtttacctttatctgtctttaatccatctttttaatcatgaatggaaatcggaagtagtatgcttctgaaactctttccagggaaacatctcttcttgatttgagaaatgcaaatttatttaacattcttatccctttcttgactaaatttaaatacttcttggtatttgggagctggattcttgtcaactgctgtataaaatatactcacaaaaccattgcagaaaagcaagaaatatttatgtagaagttcttatgaaaacttattgaatttaattttgaaaactgaagctaagagagataataaatatctagagataactattaacagtattctttcaaacataaaataataagataattgggagctgagcataaaacattatttggaaaaattaactttgcttttcttcattgcattttgtgaattc

SEQ ID NO: 3592 - DNA, 12474 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagattgaagaactctctttagcttttcttgtcagacagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaatgaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgaccatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagaggtatttggtttttataatatgtgtttttcaacattgtgtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaaccttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccacact

SEQ ID NO: 3593 - DNA, 12450 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaatgaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgaccatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaaccttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaactgaaataaaaatgacttcaccattttcaccacact

SEQ ID NO: 3594 - DNA, 2713 bp, Homo sapiens
ggatcctaggatgcttacatgcaatgatgaacccgaaaacacttgcaaagtgctacgcaaatattgatcacgaagaaggaagtcctcttcccgcctggagactgtgtggggtatggcggggtggtggggagaatgtggtgtcttgctccaccctcctggcgaggggagggcctggcctggaccgcagaggaatcgagtgactgcccctaaaatctcctagaaccgatcccgcggccccgcccctcccgcggccccgcccctcccgcggcccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattagataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgttaattgttaaaaaaaaaaaaaaaaa

SEQ ID NO: 3595 - DNA, 2387 bp, Homo sapiens
gcgcgcagcccgcggcggccatctttactcagggcacagagggtctctgcggccgtagcggccggggctgcggtagccactttagatttgggcaaggactttagattcgggctctgttctgtttccgccgtcctgcttcctgccgaggctggcccaggcagccgcgcttcgaaggacgccgccgggagctgcggagcatgcgtggagtggcagtgctaacggctggtgtctcgcactgttggcctgtgaaggtacgtgaagctgaaagcctggaatggctggaaaggggtcatcaggcaggcggcccctgctgctggggctgctggtggccgtagccactgtccacctggtcatctgtccctacaccaaagtggaggagagcttcaacctgcaggccacacatgacctgctctaccactggcaagacctggagcagtacgaccatcttgagttccccggagtcgtccccaggacgttcctcgggccagtggtgatcgcagtgttctccagccccgcggtttacgtgctttcgctgttagaaatgtccaagttttactctcagctaatagttagaggagtgcttggactcggcgtgatttttggactctggacgttacaaaaggaagtgagacggcacttcggggccatggtggccaccatgttctgctgggtgacggccatgcagttccacctgatgttctactgcacgcggacactgcccaatgtgctggccctgcctgtagtcctgctggccctcgcggcctggctgcggcacgagtgggcccgcttcatctggctgtcagccttcgccatcatcgtgttcagggtggagctgtgcctgttcctgggcctcctgctgctgctggccttgggcaaccgaaaggtttctgtagtcagagcccttcgccacgccgtcccggcagggatcctctgtttaggactgacggttgctgtggactcttatttttggcggcagctcacttggccggaaggaaaggtgctttggtacaacactgtcctgaacaaaagctccaactgggggacctccccgctgctgtggtacttctactcagccctgccccgcggcctgggctgcagcctgctcttcatccccctgggcttggtagacagaaggacgcacgcgccgacggtgctggcactgggcttcatggcactctactccctcctgccacacaaggagctacgcttcatcatctatgccttccccatgctcaacatcacggctgccagaggctgctcctacctgctgaataactataaaaagtcttggctgtacaaagcggggtctctgcttgtgatcggacacctcgtggtgaatgccgcctactcagccacggccctgtatgtgtcccatttcaactacccaggtggcgtcgcaatgcagaggctgcaccagctggtgcccccccagacagacgtccttctgcacattgacgtggcagccgcccagacaggtgtgtctcggtttctccaagtcaacagcgcctggaggtacgacaagagggaggatgtgcagccggggacaggcatgctggcatacacacacatcctcatggaggcggcccctgggctcctggccctctacagggacacacaccgggtcctggccagcgtcgtggggaccacaggtgtgagtctgaacctgacccaactgccccccttcaacgtccacctgcagacaaagctggtgcttctggagaggctcccccggccgtcctgagggggaccaggcagccctcagcagccacaggccttccaggagctgttatcactaccagtttctggcacaattccagcacaattatgacaattcagagaagcaagtcaaaggactgggcacctgcctctgacagacaccagaccaggtccagggcctcctccacagcctcagctggggctctcagcaccaaagaacgaggggcccaggtcttgttggcaccccgggagccactgcccagggtgatggtggccagctcagggcttcctgcgggtgactgtcgcccagaccaggtgccattcatgactaatcaggagcagcgggctcacccaggcacctgtctgccaggaggccacgtgtgtcctgcccacccagggggagctgtattttggcagcaccccacgcttgctgcccgagggcctcttggggcacctaagacagcaccccctctcaggggagaccatggtggccccggccgcacccccccaccctggtgccaccactgcaacttttgtattcacaggcatcccatctccatcacagataaaatcttaggagataaacacattcaaaaaggaatgagataaaaagaataaggcaataaatgttgattggaacctctcaagattacagaaaaaaaaaaaaaaaa

SEQ ID NO: 3596 - DNA, 2490 bp, Homo sapiens
ccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgttatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattaaaaaaaaaaaaaaaaaaaaaaaaaaaaaaaaaaaaaaaaa

SEQ ID NO: 3597 - DNA, 4786 bp, Homo sapiens
ctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccagacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaaaaaaaaaaaaaaaaaa

SEQ ID NO: 3598 - DNA, 14121 bp, Homo sapiens
attcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaacaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctcaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctgaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtagtggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttgacccaccaatacaagttgaaggagactattcagaagctaagcaatgtcctacaacaagttaagataaaagattactttgagaaattggttggatttattgatgatgctgtgaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtcgaaatgaaagtaaagatcatcagaaccattgaccagatgcagaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattactcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacacttgcacaccgtgacttcagtgcagaatatgaagaagatggcaaatttgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaaaaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcaatgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcata

SEQ ID NO: 3599 - DNA, 1706 bp, Homo sapiens
cgtttttgttgaaagagtcattaacggagttaggagttgatggcagtttcaataacaggtcattgccgagaaaaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctatatccagacacagaaggaatcattcacagcatatcttgaaagatgtcattcctccattggaacaactgatggttgaaaaagaaggttatctgcaaaaagctaaaattgcagatggaggaaagaaactaaggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactatgacagtgatataaaagaacagaaaccagagcacagaaaatctttaatgttcagactgcatcacagtgcttccgatacaagcgacaaaaatcgagttaaaagcagattaaagaagtttattacccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtctagatgtggatgcaatatatcgagttagtggcaatctgcaaacaatacagaagttaagatttattgtcaaccaagaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaataaaaaaaaaa

SEQ ID NO: 3600 - DNA, 1725 bp, Homo sapiens
acgtccggggaggggccaggtgagcggcagacccggcacgcaggtgggggccggcggggtccgtggccagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaaagacggggatctcactatgtggcccaggctggtctcgaactccaagctcaagcgatcctcccacctcagcctcccaaagtactgggattacaggtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataa

SEQ ID NO: 3601 - DNA, 1632 bp, Homo sapiens
acgtccggggaggggccaggtgagcggcagacccggcacgcaggtgggggccggcggggtccgtggccagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataa

SEQ ID NO: 3602 - DNA, 8595 bp, Homo sapiens
aaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgccgcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcggggggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgctggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaa

SEQ ID NO: 3603 - DNA, 7760 bp, Homo sapiens
aaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgccgcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcggggggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcaggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaa

SEQ ID NO: 3604 - DNA, 7944 bp, Homo sapiens
aaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgccgcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcggggggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgctggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaa

SEQ ID NO: 3605 - DNA, 5162 bp, Homo sapiens
gccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgctactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtctcgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattg

SEQ ID NO: 3606 - DNA, 2409 bp, Homo sapiens
agagaagaagcaggcagcttgagacaggtggagctggatcaagctgtgaacgtgatttgctggaagctggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaa

SEQ ID NO: 3607 - DNA, 2418 bp, Homo sapiens
agagaagaagcaggcagcttgagacaggtggagctggatcaagctgtgaacgtgatttgctggaagctggtcattagtgttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaa

SEQ ID NO: 3608 - DNA, 2413 bp, Homo sapiens
aacagattttaactctgaaaagccatttccagtgtctatagactattgtgagcctggagaagtagcatttagttgggatagcttcactagagctgcctgccaaagacttccttccacaggatcttgtcgcaccagcaactgacaggagcttgggagctcgggagcttgggagagggcttatgtttttaataatgtagctgtcagttcgaagcctggaaatgttgaccctcaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaaaaaaaaaaaaaaa

SEQ ID NO: 3609 - DNA, 7598 bp, Homo sapiens
gtaggccggcgccagctccactctgtccctcctcgccgggtctgtgcgtctttgcgtctgtctgtctgactgatggtcctcacacgcggttccctgtgactgggcgcgaccccggcaagcgcggcttggagggcggacggggcgcggcgatacagctgcccgctcgcatctttggccctgcgctcagctcctcacccggcgtgggaagttaaagtaaaaccgaaagggaagaaggcgcggtggcaggagctgacagagtgatgggaaacgcgtgagccaggccgagagtttcaggtttcttgctgtatggatcactgattgaataatagatggctttacctcgtctcacaggagccttgcgttccttttcaaatgtcaccaagcaagataattataatgaagaagtggctgacttaaagataaagcgatctaaacttcatgaacaagttttagatttgggcctgacatggaagaagataataaaatttttgaatgaaaaactggagaagagtaaaatgcaaagtataaatgaagacttaaaagatatattacatgctgcaaagcagatagttggaactgataatgggagagaagcaattgaaagtggggctgcatttctcttcatgacatttcacttgaaggactctgttggtcacaaggaaacaaaggctatcaaacagatgtttggcccctttccttcatcatctgccactgcagcttgtaatgctactaatcgaattatttctcattttagtcaagatgatcttactgctcttgtgcagatgacagaaaaagaacatggcgatagggttttttttggtaaaaatttagcattttcatttgacatgcatgatttggaccactttgacgaactgccaataaatggtgaaactcagaaaactataagcctagattataagaagtttctgaatgaacatctccaggaggcttgcaccccagaactcaagcctgtggaaaaaacaaatggctcctttttgtggtgtgaagttgaaaagtacctaaattcaactttgaaggaaatgactgaagtgccaagagtagaagatctttgctgtactttatatgatatgcttgcttctattaaaagtggtgatgaacttcaggatgagctatttgaactgctgggacctgaaggacttgaacttattgagaaactcctccagaacagaattacaattgtggatagatttcttaattcttcaaatgatcataggtttcaggctcttcaagacaattgtaaaaaaattttaggagaaaatgctaaacccaattatggttgtcaagtcactattcagtctgaacaagaaaagcagttaatgaaacaatatcgacgtgaagaaaaaagaattgccagacgagaaaaaaaggctggagaagatttagaagtttcagaaggacttatgtgctttgatcctaaggaattgcggatacaaagagaacaggcacttctgaatgctagaagtgttccaattctgagcaggcagagagatgcagacgttgaaaaaatacattatccccatgtgtatgattcccaggctgaagccatgaaaacatcagcatttattgctggtgcaaagatgattttgccagaaggaatccaaagagagaataacaagctttatgaagaagtaaggattccctacagcgaaccaatgccactcagctttgaggaaaagccagtttatatccaagacttagatgagatcggacagctggcttttaaaggaatgaagagactcaatagaatccagtcaatagtgtttgagactgcctacaacaccaatgagaacatgctgatttgtgcccctacaggagctggaaaaaccaacattgcaatgctgacagtcttgcatgaaattcgccaacattttcaacaaggtgttatcaaaaagaatgaatttaagattgtatatgttgctccaatgaaagccttggcagctgaaatgacagattacttcagcagacgtctagagccactaggcatcattgtgaaagaattgactggtgacatgcagttgtccaaaagtgaaattttacgaactcagatgcttgtgaccacaccagaaaaatgggatgtagtgacaagaaagagtgttggggatgtagctctttcccagattgtaaggctccttattcttgatgaagttcatttgctgcatgaagatagaggaccagtattagaaagcatagttgcccgtactttacggcaggtggaatccacacagagtatgataaggattctcggactgtctgcaactttacctaactacctcgatgttgccacatttttacatgttaatccatacattggacttttcttctttgatggccgttttcgaccagtacctcttggacagacatttttggggattaaatgtgcaaataagatgcagcagttgaataacatggatgaagtatgttatgaaaatgttttgaagcaagtaaaggctggacaccaggtgatggtgtttgtacatgctcgaaatgccactgtaagaacagctatgtctctaatagaaagagcaaaaaattgtggccatattcccttcttttttcctacccaaggacatgactatgtacttgcagaaaaacaggtacaaaggtcgagaaataagcaagtacgagaattattcccagatggttttagtattcatcatgcaggaatgcttcggcaggacagaaatttagttgaaaacttgttttctaatgggcatatcaaagtcctagtgtgtacagctacgttagcctggggtgtcaatcttcccgcccatgctgttattattaagggaacacaaatatatgctgcaaaaagaggctcctttgttgaccttggaattttagatgtcatgcagatatttggtcgagctggacgaccacaatttgacaaatttggggaaggaataattataacaacgcatgataaactcagccattacctcactttgctcactcaacgaaacccaattgagagtcagtttctggaaagccttgcagataacctaaatgcagagattgctctgggaacagttactaatgtggaagaagcagtgaagtggataagttacacttatctttatgtacggatgagagcaaatccattagcatatggcatcagtcacaaggcttatcagattgacccaacattaagaaagcatcgagaacagttggtcattgaagttggacgaaaactagacaaagctcagatgattcgttttgaggagcgaactggatatttttcctcaactgatttgggtagaactgccagccattactatattaaatacaacaccattgagacctttaatgaactctttgatgctcacaaaacagaaggtgatatctttgccatagtctccaaagctgaagaatttgatcaaattaaggtcagagaagaggaaatagaggagttagataccttattaagcaatttttgtgaactctccactcctggaggtgtagagaatagttatgggaaaataaacatcttacttcaaacttatatcagccgaggagaaatggacagtttctcccttatatcagattctgcatatgttgcacagaatgcagctagaattgtccgtgctctttttgaaattgctctgaggaaacgttggcctaccatgacctacaggctcctgaatcttagtaaagtcattgacaagaggctttggggttgggctagccctttgagacaattttcaatcctaccaccacacatcctaacaagattagaagaaaaaaagcttactgtggataagctgaaagacatgaggaaagatgaaataggtcacattttacatcatgtgaatattggactgaaggtcaaacaatgtgttcatcagattccttctgttatgatggaagcatccattcagcctatcacaaggactgtcctccgagtgacactcagcatctatgctgatttcacttggaatgatcaggtacatgggacagtaggagaaccttggtggatttgggtagaagatcctacaaatgatcatatttatcattcagagtattttctagctctaaaaaaacaagtcattagtaaagaagcccaactactggtatttacaatccctatttttgagcctttgccttcccaatactacatccgagcagtgtctgatagatggttgggtgctgaggcagtatgtattatcaactttcaacatctaattctaccagagagacatcctcctcatacagaattactggatcttcagcctttaccaatcacagctttgggatgtaaagcatatgaagccctgtacaacttcagccactttaaccctgtacagacacaaatatttcatacattgtatcacacggattgtaatgtcctacttggagcacctactggatcgggaaagactgttgcagctgaattagccattttcagagtcttcaacaaataccctacttcaaaggcggtatatattgcacccctaaaagccctagtacgtgaaagaatggatgattggaaagttagaatagaagaaaaacttggtaaaaaagttattgaactaacaggggatgtgactcctgatatgaaatccattgccaaggctgaccttatcgtcactacgccagagaagtgggatggagtcagcagaagctggcaaaataggaactatgttcagcaagtcactattctcatcatagatgagatccatctgcttggggaggaaagaggccctgttctagaggtcattgtatctcgaacaaattttatctcatcacacacagaaaagcctgttagaatagttggactatctactgcattagctaatgccagagaccttgctgattggctcaatattaagcagatgggcttgtttaacttccgaccatcagtacgcccagttccactggaagttcacattcaaggctttccaggtcaacattactgtcctcgtatggctagtatgaacaagcctgcatttcaggcaattagaagccattctccagccaaacctgttttgatatttgtctcatcaagacgtcaaactcgtcttactgctttggaattgatcgccttcctggctactgaagaagatccaaagcagtggttaaacatggatgaaagagagatggagaacatcattgcaacagtaagagattccaacctcaagctgacccttgctttcgggataggaatgcatcatgctggactacatgagagggaccgaaaaacagtagaggaactatttgtaaactgtaaagttcaggttcttattgctacaagcacattagcctggggtgtaaactttccagctcatttagtaattattaagggaacagaatactatgatggaaaaacaagacgttatgtggattttcccattacagatgtcctccagatgatggggcgtgctgggaggccgcagttcgatgaccaaggcaaagctgtaattctagttcatgacataaagaaagacttttataaaaaatttctttatgaacctttcccagtagaatcaagtttattaggagtgctctctgaccacttaaatgcagagattgctggtggtacaattacatctaagcaagatgcattggattatatcacctggacttactttttccgacgtcttatcatgaatcccagctattacaatttgggtgatgtgagccatgattctgtgaacaagtttctgtcccatctgattgagaagtccctgattgaattggaactttcctactgtattgaaattggagaggataatcgcagcattgaacctctaacttatggccgaattgcctcctattactatttgaagcatcaaacagttaaaatgttcaaggaccgcttgaagcctgaatgcagtactgaagaactgctttcaattctaagtgatgcagaagaatatacagatttgccagtgagacacaatgaagatcatatgaatagtgaactggcaaaatgtcttcccattgaatcaaatcctcattcatttgacagccctcacaccaaagcacatctcctgctacaggcacatctcagccgagccatgctaccctgcccagattatgacactgataccaaaacagtcttggaccaagctctcagagtatgtcaggcaatgctggacgtggctgcaaaccagggctggctggtgactgtcctgaatatcaccaacctgattcagatggtgatccagggtcggtggttaaaggactcttctcttcttacactaccaaacatagaaaaccatcatcttcaccttttcaagaaatggaagccgattatgaagggcccacatgctaggggtcggacctccatcgagtcccttcctgaactgatccatgcctgtggagggaaagaccatgtatttagctccatggtagaaagtgagctacatgctgcaaaaacgaaacaggcatggaatttcttatctcacttgccagtgataaatgttggcataagtgttaaaggctcgtgggatgacttagttgaaggacataatgaactctctgtctcaactctgactgcagacaaacgagatgacaacaaatggatcaaattgcatgctgaccaagagtatgtgcttcaagtgagcttgcagagagtccactttgggttccacaagggaaagccagagagctgtgcagttactcctcgatttcccaaatcaaaagacgaaggatggtttttgatattaggagaagtggataagagagaacttattgctttgaaaagagtaggatatattcgaaatcatcatgttgcttccctttctttttatacccctgaaatacctggaaggtatatctacacattatatttcatgagtgactgctaccttggcctggaccagcagtatgacatctatctcaacgttacacaagcgagtctttctgcacaggtcaacaccaaggtctctgattccctgactgacctggcattaaagtaacttgacctgaacaatccatttgaaaggagtggctaagaattctctctgttcagtcatctagacaaatcgaattacttgatgtttgccttgaaagaatcaacttctaacctcaaccatccaggaaattgacagtggctgcagtattgactccagtgacataaagttaaccacagtggccttttaacaaatgttgccttttataatgttatctttatgagtttcttgatatgtaagatgaaaaagcatttagaataatcttttaatttgtgtatatttgggatgatatttaggagctatcaatcaaattttacatctcacaatgtactgtttacatggatattggctgctttttttaaggaaaaccacattgagatgtgacaagtgttaggacttgtcacagatttctaactctgccgcataaactataaatctgtaaggtggtacacagcgtgtcttgttagcaaaatttatactttgatatgatcacatgtagaagtagcttcaagaatttcttgtagtcataaatgtttaataatatatgatgtaaaattatattatggagcctaatgatgataacaaagaaaacaatatactgatcttagaaaatgtagacatggttaactgggaaataaaatatagagtggcacttcaagaaaaaaa

SEQ ID NO: 3610 - DNA, 3470 bp, Homo sapiens
gtaggccggcgccagctccactctgtccctcctcgccgggtctgtgcgtctttgcgtctgtctgtctgactgatggtcctcacacgcggttccctgtgactgggcgcgaccccggcaagcgcggcttggagggcggacggggcgcggcgatacagctgcccgctcgcatctttggccctgcgctcagctcctcacccggcgtgggaagttaaagtaaaaccgaaagggaagaaggcgcggtggcaggagctgacagagtgatgggaaacgcgtgagccaggccgagagtttcaggtttcttgctgtatggatcactgattgaataatagatggctttacctcgtctcacaggagccttgcgttccttttcaaatgtcaccaagcaagataattataatgaagaagtggctgacttaaagataaagcgatctaaacttcatgaacaagttttagatttgggcctgacatggaagaagataataaaatttttgaatgaaaaactggagaagagtaaaatgcaaagtataaatgaagacttaaaagatatattacatgctgcaaagcagatagaagtgaattgtccattccagaagaggaggctggatggaaaagaggaggatgagaagatgagcagagcttctgacagattcagaggactaagatgacaaaaatgactaaaatggacaaaagaagaaatagaaaatctgaatatttgactattaaaggaatttaatctgtaattaaaaaccttaagtacaaagaaatctatatgctatgatggctttaatggagaatgtcataatgtcatttaaaaaggtatgagagtactattgtagattaaaagaggttaaaggcatataataatcaaaatgtaatgtatgatccttgattgactcttgaatcagaaaaaaattacgtatttttggggccgttggagaaatctgaatatgggctggacatcattaggtaatattagatctcaggtgtgataatgttgtggctatgtaagaggatatcctaaatctcaggagaagcatactgcagtatatatagtggtatctcatgaagattaaaatgtactgtcaaatgtgtcagcaaaagaaatacacatgatgtgtgtgtgtgatcaagtgtttataatgagtggattaataaatatgagaagatagggtgatttgttgtaaagtaataaaggtttaaaaattacatgattcagtagagaaaaagcattttatgaatatctaacattacttatgataaaaaatctcagcaaactaggaatagaaggggattttgttaatctgataagctgtagctataaaaaacttggagaaaacatacttaatgctacaaagttagaagcttccctgaggtacggaattagacacaaatgcctgttaccacttctgtttctcactgtattaaaaatccttgctaacataatatggcaagaaaaagtaagggcataaagactggaaaaaaaaacttttccatttttcacatgactgtacctgtagaaaatgaatttaacaaggttaatataaaaatcaattttatttctacttactagaagcacattaaaaattacacttatctttatgtaacgtaatacattttaccttaaattttaaaattttaatttattttacgtttacaaaagcatcataaacatcaaatacgtaggagtaaatttaacaaaaaataagcaagacttcatggaaaactaaaatattgagagaatttaaagaagatctaaataaacagagggatataccaagaattggaagactcactattataatgatatattttttacccaaattgatctgtagattcagtgctatcccaggcacagtcttatgtttgagggtgtgtgtgtgtgtgtgtgtgtatgtgtgcatgtgtgtgtgtggaaattgacaagggtaatatgaaagttatatggaaattcaaaggcaaagagcagcctggttaactttgaaaaataaaaagggagaacttactctagtagatcttaaaacttattataaagataagtatacagtgtggtgttggtccaagaataggcaaatggactagtatgacagaatatagcccagaaacaaacctacggatagaaatatacttgatttataatgaaggccaaacaatagtgagacaaggctattttttcagtatatggtgctgggtcaactgcatatacagatgaaaaaaagtacctattttacaaataattttaaacagcctacagaattaagcatgatacacaaaacaatacatcttctaaaagatgtaaaagagtgtcttcaggatctttgtatgtgcgaaaatttatcaaacagagaacaaaaagtacaaagggaatgattaagttggactgtagtaaaattaataccttctatttattaagagtaaaaaggcaaaacatggagtgggagaatatagcttcaagatatataaccaaaaagagagcttttatccaggttaaatacgagctcctacaaatcaataaggaaaggacagataatcctatatgaacatgagtaagagctttgaacaaggacttcacaagagatagttgaccagtaaacatgaaaagggcttcagcttcattggtagtcaaggatatgccactgcatgcccattagaatggttaaaatgtaaaagactgacatacctattgttaggatcaagaatgtgaactagaatttttgtctactgctgctagagtttacaattggtacaaccactttgagtaactgtttgacagtgtctactattacctactgtggttggacaagtgaaattttaaatcttaggacataaatatccaataaaaatgcttgtacatacatgtatatcaaaaataggtgcattcattgcaacattatttgtgatagccttaatgtagaaacaacccagttcattgttaaaaagcttaagttgtagtatgtagactgccttatagcagtaacggattacagctatgtataacattgtaagtgaatcttataatgttgacaaaagaagccatacaacacatattatgattccattaatatgaaactgaaaactaggcatgaccagtctctggttttagaagtcaggatagtggctgcttttgaggaaggaggtagtgactaggagtgaatatgagggaggtttctggggagctgataatgttctgattcttgaagtagttaaccagattacacaggtgtgttcgttttttgataattctttgaactgtatgtgtactgtatattttcttgttatattcaataaaaagaattactatgatttttatattacatagattaaataagaagtatttcagattgataagtaacacatgcttgtgtatttatttagcttaaggtttggctatcatggtgagaactcctatgtaccctgctcaggtcctggtaaacagtatcataagtataataaattggtgtttttcattctca

SEQ ID NO: 3611 - DNA, 1994 bp, Homo sapiens
aaacttcccgcacgcgttacaggagccaggtcggtataagcgccagcggcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatct

SEQ ID NO: 3612 - DNA, 2348 bp, Homo sapiens
cctttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaaaaaaaaaaaaaaaaaaaaaaaaaaaaaaaaaaaaaaaaaaaaaaaaaaaaaaaaaa

SEQ ID NO: 3613 - DNA, 2345 bp, Homo sapiens
cgcaggcatgatgaaacttcccgcacgcgttacaggagccaggtcggtataagcgccagcggcctcgccgcccgtcaagctgtccacatccctggcctcagcccgccacatcaccctgacctgcttacgcccagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaaaaaaaaaaaaaaaaaaaaaaaaaaaaaaaaaaaaaaaaaaaaaaaaaaaaaaaaaa

SEQ ID NO: 3614 - DNA, 2452 bp, Homo sapiens
agctgcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaa

SEQ ID NO: 3615 - DNA, 1254 bp, Homo sapiens
cctactttacgatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcacagaatatgatgtaataacttctatttattgatcatttattgatcatgtattcagataaatgtatatgtatcatgaatttttatggattaatatattgaatactttcattgacgttaaataagaatattaagattttaaatgttaccctgtgcataatgccttgtaactttttcaagtatgctaaatactcagggagatggatttgctcgttgttttcttccctccttccccttcctgcttccctgttttctctttcgtggacacctccccaggctcatgtgccaccaccttccctcctctccagccctcccagccctcccgcagccttt

SEQ ID NO: 3616 - DNA, 2680 bp, Homo sapiens
cggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttacaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaattaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagacgatactcaaattataataaaactcttcattttgtgaattatagaagctactttttataaagccatatttttttagggaaactaaggagtgacatagaactgatgaatgagcaaaagtaagttttgctggatttttgtagaactctggacgttgaggattcattatgctgtggttaactttaaatatttttgaattccaaatatctgaattaatgagccttgtgtttacaaatatgtgccattgtgcaacatcggtggattttctaaaaataatgtaaatgtcttctattaaatgttgagtgcaataaaatccagaa

SEQ ID NO: 3617 - DNA, 1279 bp, Homo sapiens
gcggccgcgtcgacatgcagtgtgcctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcacagaatatgatgtaataacttctatttattgatcatttattgatcatgtattcagataaatgtatatgtatcatgaatttttatggattaatatattgaatactttcattgacgttaaataagaatattaagattttaaatgttaccctgtgcataatgccttgtaactttttcaagtatgctaaatactcagggagatggatttgctcgttgttttcttccctccttccccttcctgcttccctgttttctctttcgtggacacctccccaggctcatgtgccaccaccttccctcctctccagccctcccagccctcccgcagccttt

SEQ ID NO: 3618 - DNA, 2773 bp, Homo sapiens
caagctctggtaggcaagtgcatgcagtgtgcctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattctctaaaaaaaaaaaaaaaaaa

SEQ ID NO: 3619 - DNA, 5468 bp, Homo sapiens
tctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaaaaaaaaaaaaaaaaaaaaaaaaaaaaaaaaaa

SEQ ID NO: 3620 - DNA, 6950 bp, Homo sapiens
ggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagatggatgtagtgaatgctttccagagtggaagttccattcagggggctctaaggcggcaaccctccatcgccagccagcatcatgatgtaacaaatatttctacccctacacatgtagtgttttcctcttctactgcttctactactgtggggtattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaaaaaaaaaaaaaaaaaaa

SEQ ID NO: 3621 - DNA, 6796 bp, Homo sapiens
ggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaaaaaaaaaaaaaaaaaaa

SEQ ID NO: 3622 - DNA, 1950 bp, Homo sapiens
tctggcattgcaagcctcgcttcgttgccacttcccagctcttcccgccttccgcggtataatcaacactacgagagatagagccgcctagaaccagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagttaaaaa

SEQ ID NO: 3623 - DNA, 1895 bp, Homo sapiens
gtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagttaaaaa

SEQ ID NO: 3624 - DNA, 1675 bp, Homo sapiens
gtgacaaccggaagcggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaatttactgttaagtcatgttctcatgctcagatcagtagtgtcagccagagctttctctgcagacatgtaggaagtgggtagctatttttcccactccatgtattagagttttacaaaaaggcttacttttgagacaactgttgcattttggggtactaataaatgattgccgatgagttaaaaaaa

SEQ ID NO: 3625 - DNA, 6175 bp, Homo sapiens
agttggcgcgggccgcgggcgaggcggggccgcgcgcggggtcccctcctcctgccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttggactattttgaaagaaagtgggtttgccagataccttcattcagctgttcttatcaatggagctatgcttatttttggaggaaatacccataatgacacttccttgagtaacggtgcaaaatgtttttctgccgatttcctggcatatgacatagcttgtgatgaatggaaaatactaccaaaaccaaatcttcatagagatgtcaacagatttggacactctgcagtagtcattaacgggtccatgtatatatttgggggattttctagtgtactccttaatgatatccttgtatacaagcctccaaattgcaaggctttcagagatgaagaactttgtaaaaatgctggtccagggataaaatgtgtttggaataaaaatcactgtgaatcttgggaatctgggaatactaataatattcttagagcaaagtgccctcctaaaacagctgcttctgatgacagatgttacagatatgcagattgtgccagctgtactgccaatacaaatgggtgccaatggtgtgatgacaagaaatgcatttcggcaaatagtaactgcagtatgtctgtcaagaactacaccaaatgtcatgtgagaaatgagcagatttgtaacaaacttaccagctgtaaaagctgttcactaaacttgaattgccagtgggatcagagacagcaagaatgccaggctttaccagctcatctttgtggagaaggatggagtcatattggggatgcttgtcttagagtcaattccagtagagaaaactatgacaatgcaaaactttattgctataatcttagtggaaatcttgcttcattaacaacctcaaaagaagtagaatttgttctggatgaaatacagaagtatacacaacagaaagtatcaccttgggtaggcttgcgcaagatcaatatatcctattggggatgggaagacatgtctccttttacaaacacaacactacagtggcttcctggcgaacccaatgattctgggttttgtgcatatctggaaagggctgcagtggcaggcttaaaagctaatccttgtacatctatggcaaatggccttgtctgtgaaaaacctgttgttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacagtgagatggttcttgacaccaatctttgccccaaagaaaagaactatgagtggtcctttatccagtgtccagcttgccagtgtaatggacatagcacttgcatcaataataatgtgtgcgaacagtgtaaaaatctcaccacaggaaagcagtgtcaagattgtatgccaggttattatggagatccaaccaatggtggacagtgcacagcttgtacatgcagtggccatgcaaatatctgtcatctgcacacaggaaaatgtttctgcacaactaaaggaataaaaggtgaccaatgccaattatgtgactctgaaaatcgctatgttggtaatccacttagaggaacatgttattacagccttttgattgattatcaatttaccttcagcttattacaggaagatgatcgccaccatactgccataaactttatagcaaacccagaacagtcgaacaaaaatctggatatatcaattaatgcatcaaacaactttaatctcaacattacgtggtctgtcggttcaacagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacagattgcattctcacaacacaatacaatcatggaccttgtgcagttttttgtcaccttcttcagttgtttcctatccttattgctggtggctgctgtggtatggaagatcaaacaaacttgttgggcttctcgacggagagagcaactgcttcgagaacgacagcagatggccagccgtccctttgcttctgttgatgtagctctggaagtgggagctgaacaaacagagtttctgcgagggccattagagggggcacccaagccaattgccattgaaccatgtgctgggaacagagctgctgttctgactgtgtttctttgtctaccacgaggatcatcaggtgcccctccccctgggcagtcaggccttgcaattgccagtgccctaatagatatttcacaacagaaagcttcagatagtaaagataagacttctggagtccggaatcgaaaacacctttcaacacgtcaaggaacttgtgtctgaccaaactcagtctgagaatgtgacagctttccgcctaactagaatgcagaccagaatgagttcaactcattctgtgcaacttcacagggggtttattagaatgctcagtgtagaggacattcctgtcatccatgccaactacctaactcgttatcagagctgatagagcatggaaaagtctgtccagcgatcagttgttcccctccttccaaaaacagcctccaataccacaacctgaaaagagccgaaatggttattttacagcatacaagcttctgctccagtatgataatttttaattgcctaagaatcattggatcagacctaaatgatccatctgcatttttataagaatggatctttctttgcccttcctctcctagctgctagattttaactaccttttacaaatgttacaaaatgtattttagaggcgacatctctcaagatgacctgagttccttcctgccaactgttccacctagaatacaagtagagaagagcactggctggcaagcatcaacaggagtcttcttcccaacacgagcgcatccatgtcctgagaaaaagtctgtggtttagaaaatatgtccatggttgcccacagtcagcacactcttagtgactcaaaattctgaattatggcagaaaggaaaaataaaacatacttcacattagaacacagaatcatttacatcctaatactgaccacagttcactaaagctcagtagcattaacagatatagtttggaattgcagtttcctcacttcagggtgacaagatatgtataacagtgacagaaatctccaaagctgctgtatatgatatagctttgttaaatatgaaggtcctttaaatacaattgatgtttagtactatatatgtacttttcacattctttggatttctggaaggttatgacactttactgtttacagctaatgcatagttacttgcatgccatggttgtacagtagcagactatgaccctattgtgatattaagtgtttatttcataatgccatttatacatagctgaatttgatgaggattgaatgtcatatataagaggaatgatcatacaatatgtagttgcatcttatataagatttctaggttgcatctaaccatgactatgtcattattttgataattaggcatttatgaattatagtatatattcctcatgttggcatgataattttgctattttccatgcattaaaaatcagccttccatctgtaaagggcggtaatggtgcccacctttcgaggcattgcgaggctagatggtaacacacagaaagctcccacagtgggaccttgatgcagcgtagctggtattaacaaccgtggggacaccaggccactctttttctaccagttgttttatgaatccacctattaattttcatccatcttttggtcgtaggtaaaggtcaatcaggtttttcaaaaagactccctgaataacttaagttcctgtattgccagtgttcaaaagattgtgtaaaagttcaagcccgttttagaaagccaacattttatgttataatatgctgttaatcaggactttattaaataaaaacattggctcttccaaaaaaaaaaaaaaaaaaaaaaaaaaaaaaaaaaaaaaaaaaaaaaa

SEQ ID NO: 3626 - DNA, 1127 bp, Homo sapiens
cacgggcggggcggggcctgggtccaccggggttctgaggggagactgaggtcctgagccgacagcctcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgcc

SEQ ID NO: 3627 - DNA, 956 bp, Homo sapiens
gagcccggggtgctggagggaggcggcaggcccgggtcaggtgcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgcc

SEQ ID NO: 3628 - DNA, 5538 bp, Homo sapiens
gccccagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaat

SEQ ID NO: 3629 - DNA, 6085 bp, Homo sapiens
tctctctctctctcactcactcactctctctctccctctccctctcctctccttcctcctccgcctcctcagctcttgggctagaatatctatgggtcgaaacgtgatgcgatgaattcgagagagagcgaaactaggacgaggagtgcggcggaagcggcgggactcccgggcatgggggcttcaccacaatagaggcagcgcccccacccgcccccgccagcccctccggagcgaagcccccaaaccccctcgggaaaaggatggcggcagcacctacccagatcgaagccgagctgtattacctgatcgctaggttcttgcagtctggaccctgcaacaaatccgctcaggtgctagtgcaggagctcgaggagcatcagctgattccgcgccgcttagattgggaggggaaagagcaccgaagaagcttcgaggatctggtggcagcaaatgcacacattcctccagactacctccttaaaatttgtgagagaattggtcctttactagataaagagatccctcagagtgttcctggggtacagacattattaggtgttggtcggcagtctctgctacgggatgccaaagactgtaagagtacactatggaatgggtctgcttttgcggctctgcatagaggcagacctccagaactacctgtaaattatgtgaaacctccaaatgtggtgaatatcacctctgccaggcaattaaccggctgtagtcgctttggtcatattttcccttcatctgcttaccagcacattaagatgcataagagaattctggggcacttgtcatctgtctactgtgtagcatttgaccgaagcgggagaagaatttttacaggttccgatgactgtttagtaaaaatttgggctacagatgatggacgccttcttgctacacttcgtggacactctgctgaaatttctgacatggctgttaactatgaaaacactcttattgctgcaggcagctgtgataaggtagtaagagtatggtgtcttcgaacttgtgcacccgttgcagtccttcagggccattcagcttctattacttccatacagttttgtccatcaactaaaggcacaaacagatacctcacttctactggtgctgatggaacaatctgtttctggcaatggcatgtaaaaacaatgaagtttagagatcgcccggtgaaatttactgagagatccagacctggagtccagatatcttgttcatctttcagttctggtggtatgttcattacaactggtagtactgaccatgtgattagaatatattatttgggttctgaggttcctgagaaaattgctgaattagagtcacatacggataaagttgttgctgttcagttctgtaacaatggagacagtttaagatttgttagtggaagtcgagatggaacggcaagaatttggcagtatcagcaacaagaatggaagagtatagtgctagacatggctactaaaatgactggcaataatttgccatctggagaagacaagatcactaaacttaaggtgactatggtggcctgggatcgctatgataccacagttattactgcagtgaacaattttcttttgaaagtgtggaattctatcacaggacagcttcttcatacattatctggacatgatgatgaagtattcgttctagaagcccatccatttgatcaaaggatcatactttcagcaggtcatgatgggaacatttttatttgggaccttgaccgggggaccaaaattcggaattactttaacatgattgaaggccaaggccatggtgcggtgtttgattgtaaattttcaccagatggaaaccattttgcctgcacagattctcatggacatttgctgctttttggttttggatgcagtaaatactacgaaaagattccagatcagatgttcttccacacggattatcgtcctcttattcgtgatgccaataactatgtattggatgaacaaacccaacaagctcctcacctcatgcctcctccatttttggtggatgttgatggaaatcctcatcccacaaaattccaacggttggtaccaggacgggaaaattgtaaagatgaacagcttataccacagctgggatatgtggctaatggtgatggtgaggtagtagaacaggtaattgggcagcaaaccaatgaccaagatgagagcattcttgatggaataatcagggagctgcagagagaacaagacctgagactaattaatgaaggagatgttccacatttaccagttaatagagcatactctgttaatggtgctctgagaagtccaaacatggacatatcttcttccccaaacatcaggcttcgaagacatagtagtcaaattgaaggtgttagacaaatgcataacaatgctcctcggagccagatggccactgaaagagatctcatggcgtggagcagaagagtggtggtcaatgaactaaataatggggttagtagggtacaggaagaatgtcgaactgcaaaaggtgacatagaaatcagtctttatacagttgaaaagaagaaaaagccatcttacactactcaaaggaatgattatgagcctagctgtgggcgttctttacgcaggacacagcgcaaacgtcagcatacttaccaaacacggtccaacatagagcataattcacaggcatcatgtcaaaattcaggtgtacaggaagactcagacagttcttcagaggaagatgaaactgttggcacaagtgacgcttcggtagaggatcctgttgttgaatggcaaagtgaaagttcttccagtgactcatcaagtgaatattctgattggacagcagatgctggaataaatttacaacccccaaaaagacaaaccagacagacaacacgtaaaatatgcagcagctctgatgaggaaaatttgaagtccctagaagaaaggcagaagaaacctaagcagactagaaagaagaaaggaggactggtttctatagcaggtgagcctaatgaagaatggtttgcccctcagtggatcttggatactataccccgacgttccccatttgtcccacaaatgggagatgagcttatctattttaggcaaggacatgaagcttatgttcgggctgtaaggaaatcgaaaatatacagtgttaatttacaaaaacagccatggaacaaaatggatctcagggagcaagagtttgttaagattgtaggaatcaaatatgaggttggcccacccacactgtgctgcttgaagcttgcatttctggacccaatttcaggcaaaatgactggagaatctttttccattaagtatcatgacatgccggatgtcattgacttccttgtgctacatcagttttataatgaagccaaagaaaggaactggcagattggtgatagattccgcagtataatagatgacgcctggtggtttgggactgtggagagtcagcagccttttcaaccagagtatcctgatagttctttccagtgttacagtgttcactgggacaataatgagagagaaaagatgagcccatgggatatggagccaattccagaaggaactgcctttccagatgaagttggtgctggtgttcctgtctcccaggaagaattgactgctttgctatacaaaccccaggaaggagagtggggggctcattccagagacgaagaatgtgaacgggttattcagggcatcaaccaccttctttccctggattttgccagcccttttgctgttccagtggatctcagtgcctaccccttgtattgtactgtagttgcttatccaactgacctcaataccatcaggcggagacttgaaaatcgcttttacaggagaatatcagcattaatgtgggaggtacgctatattgaacataatgccaggactttcaatgagccagacagtcctatagttaaagcagctaaaattgtaactgatgtcttacttcgatttattggggatcagagctgtactgatatactggatacttataataaaattaaagcagaagaacgaaacagtactgatgcagaggaggatacagaaattgttgatttagattcagacggtcctggtacttcatctggaagaagggtcaaatgccgaggcagaagacagtctttaaagtgtaatcctgatgcttggaaaaaacaatgcaaggaactattgagcctcatttatgaacgtgaagactcggagccatttcgacagccagctgatcttctttcttacccaggtcatcaggagcaagagggagaatcctcagagtctgttgttccagaaagacaacaagattcatctctttctgaggattatcaagatgttatagatactcctgtggacttcagcactgtgaaagaaactttggaagcaggaaactatggtagtcctctggaattttataaggatgttcgccaaatattcaacaactccaaagcttatacctctaataaaaagtcaaggatctatagcatgatgctgcgattatctgccttatttgaaagtcatatcaaaaatatcatctctgaatataagtcagcaatccagagtcagaagaggagaaggccacggtacagaaaacgtctaagaagcagcagcagttcattatctagtagtggagcacctagtccaaaagggaagcagaaacaaatgaagttgcagcctaaaaatgaccagaatacctcagtatctcatgccaggactagctctcctttctcatctcctgtttcagatgctgctgaagggctttcactatatctacttgatgatgagccagatgggccattttcttcatcgagcttcggtggatatagccgaagtggaaatagccatgacccagggaaagccaaatcatttcggaatagagttttgccagttaaacaagatcactcccttgatggaccccttacaaatggtgatggcagagagccccggacaggaatcaagagaaaactacttagtgcatcagaagaagatgaaaacatgggaggagaagataaagagaaaaaagaaacaaaagagaaatctcatttatccacctcagagagtggagagttaggatccagtttaagttctgaaagtacctgtggttctgactctgactctgaatcaacttccagaacagatcaagattacgtagatggagaccatgattatagcaaattcatacaaaccagacctaaaagaaaactcagaaagcaacatggcaatggaaaaagaaattggaagaccagaggcacaggaggaagaggcagatggggaagatggggtagatggagtagaggaggcagaggaagaggaggcaggggacgagggagtcgaggaagaggtggaggtggcactagggggaggggaagagggagaggaggaagaggtgcttctagaggagctaccagagccaaacgagcacgtattgcagatgatgaatttgataccatgttttcaggacgtttcagtagactgcctcgaattaaaacaagaaaccaaggcaggaggactgttttatataatgatgattctgataatgacaattttgtgtccactgaggatcctctgaatcttggtacatccagatcaggcagagtgcgtaaaatgacagaaaaagccagggttagccatctcatgggatggaattattaacagttaataaatttagaataacttaaaaaattcaatggccttctactgcagggaatttaccaggaaatctacaaagcaagttgtgtggggacttctgcttcctttcacattggtgcttttccatttatgccagtatacatttgtttcaagacttttgatctccacacttcatttgttcaaataagccttactcattaggccttaaattaaaagaaattctgcccacacacacacaaacacatacacacacatacacacacacagacacacacacacgaaacacaacacagacactacagatttactacattaaaggagcattcagcttcttaagagtagcatgacatttttatctcaatagaatagccctcttttgcttttgtatcacagaagtatagcaccttcttacagag

SEQ ID NO: 3630 - DNA, 1262 bp, Homo sapiens
tgtgtcacttccggcctccctttagctgccatcttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtatacagttttatttttttatttcattgacaccgatctgtacacagtaaaaaaaattgcttatagaaagctaatcatggcatgtaatatggctgataacctttggaatttgattaaagatttaaaatcacaaaaaaaaaaaaa

SEQ ID NO: 3631 - DNA, 1021 bp, Homo sapiens
tgtgtcacttccggcctccctttagctgccatcttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtatacagttttatttttttatttcattgacaccgatctgtacacagtaaaaaaaattgcttatagaaagctaatcatggcatgtaatatggctgataacctttggaatttgattaaagatttaaaatcacaaaaaaaaaaaaa

SEQ ID NO: 3632 - DNA, 1869 bp, Homo sapiens
ggggctgcgccgggttccgtgtgtctatgtcaatgtgtctgtccttcactcctccattgtctgccgccactgctgctgctgctgctgctgccgctgctgctgcacgaatcgccgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatctggaaaaaaaaaaaaa

SEQ ID NO: 3633 - DNA, 2970 bp, Homo sapiens
acttgacaccacgcgggtgttgcagtgcggactgtttgcctcttccccaccaagaacaccatttggtttcccccggctgggtctctatttagatgggcagtgatgacaccaaatataagcataaaaagacgttttaaaactacagatcctgaaacccagcacggcaggcacctgcagcttccagtgctgtaacagagaaaaaaaaaaatccccactttgcaattgcatctggtcaatgagaggctctagttttggggaagagggaaacacctaaccttgacagaatcatcaccagagacacctgccggctgacaaggacagctttcttggagccaacagatgatgcaaggaaataagaagtgcacagacgcgttcagcgactcctccagcatcggcagcgtgttggatgatgcagacagggaggtgagcagcctaacagaccgggcattccggagtttgtgcatctccgaggacacatccttccatgactcctatctggctgtgtccccggatatcacccgacaggtgtttgggacttttcaccagagaacagtgggccacacccagaggaaaagtggcatttggagccagttaccgtcacagggcacggaacattcgggctgggcggccaccttccaacagctacccaagtacgttcagggagaggaaaagtaccccaaaaccagccccccaccaacgccagtccagaggagactggaggtgccagtttccggcctaaggagcagcaataagcctgtctccaaagtatcaacactaattaaatctttcgacaggaccgagagccaacgttgtgagagcaggcccactgccagcaagcctccggctctgaaaaatcctcccaaattcgctcctcttccagaaaacagtgtcaacttctgcttcgattctgcctttctgacagtcaggagggtgcccgctgaagtttccaacacccatcagaacagctaccagccaggcaggaagcacggagaacaggagtcctccaagaatccagaaatggcctgtcacggctccagcagcttcctcccagcagccaatgacacggccaccttatgtgagtcaaagttcccctctccacaccacaagccagtcacgggtgagcctgggagaggcaaaggtacctttctgcacagtgaaaatagtgcttttgagtcatggaatgcccaccaaccaaagctgctggagagaaaggacacagctggaaccgtcccagaaagcaaagctcccaagcactatggggacacgaccttgctaagagaaccctgtcctcctgagcgcacagtctctccctgccaggtccaggccagctgcagtcaggaagagaacagactcgcagcaggggctctgtccacatctataccctgggggtgcagggatccaggagcccaggtatttgctgtggaaggaaaagctcccagctcacaacctgattctcaagagaagccagcccagcccccatggaggaagccaaagactggcaaaaaagggaaagaaagtctacaagatactttagaagaaaagacacagaccaaccagagaggcccacctttgtatacaaaacacaacccccaggaacagttttcagaaaacaatgctcttgacctgcctgtggaacccaatgaacattatgatcccccctttaacatcagtaagctcctgacccccatcatacccagcaagcacgccctggattcagcagacagccagccagcagagcgaaccccatcacccccaggacagctaaacggataccaagagaaggagcccagtgaatgtcagtctcgagacagctacaagtccaaagcccctagcctgctgttcaacctcaaggacgtgcggaagcgtgttaagagcacatacagttcctcacctctcttgaaagtgcttgatgagaaaactagaggtaaggttgatggaaagcaagaacctgtgagcaacggtgtcatcctccccaatgggcttgaggaaagccctccaaatgagctttctaaggagagacccgctgatgaccccactgcatcacacatcaatccccagaaggaccctacagctgaccccagtgagccctctgcagacagctatctaactcttagcacagctccgactatcgccaaagcccccttctatgtcaatggggaggctgctgagagaagcagttatgagaacaaggaggtggaaggagagttggagatgggtcctgccggatccagctggtgtccagactccagggaacaccgccccaggaaacacctctccctgaggctttgcaatagggatcctgagcctggaggggctacagagaaaatgaagacccaccagctagagaatgggctctccagatctgtgtcccaagagacagaacctgagagggaagcaggacttcagaacacacacacacacacacacacacacacacacacacacgatcatcaacacatacttagcctttttagatccataaagtccagaaggcagtagggatcccaagacgacctcacccaaagggctccctggctctcctctgatggaggggcactgcttgcttggcccggtcccctccgtgccagttcccaggcgcactctactccagcccttctccctccctcccttcctccctctcctggcccaccctgctcttccctcgccctgcaaattaggtgggtgtggcaagggcaccgcctggtcccaagtgtccctctgtacccacacccacccactcacttgtaagctccttgatgagcaaacccctaaggcccccagctcagactcagcaggcattcaggtcaactcaggcagactggctaaggaccagcccagggcaattttgcagaaatgatcatttgcacagaatgggtttccttcacagggagaaacttgcctctgaaagctattttctgatcaagaaaaggcccactttttaaaaagtgaaacaagtttgcagatacggtt

SEQ ID NO: 3634 - DNA, 2375 bp, Homo sapiens
aagtggcaccagcacttccggtacggaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccggttcctcatcatgtccgaactgactaaagagctgatggagctggtgtggggcaccaagagcagccccggtctctcggacaccattttctgccgctggacgcaagggtttgtgtttagtgaatcagagggatctgcattagaacagtttgaaggtggcccctgtgctgttattgcacctgttcaggcatttcttttgaagaagctcctgttttcttcggagaagtcttcttggcgggattgttcagaggaagagcagaaggaactcctttgtcataccttgtgtgatattttagaaagtgcttgttgtgaccactctggatcatactgcttggtttcatggttaagaggaaagacaactgaggaaactgctagtatttctgggagtcctgcagagtctagttgccaagtggaacattcttctgccttggctgtcgaagagcttggctttgagcgatttcatgcattaattcaaaaaagatcgttcagaagtttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgaaacttcttggtatacatgaacaagcagcagtaggatttttaacactaatggaagctttaagatactgtaaggttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatatataaatctcatgaagaataaattagatccagaaggattaggaatcatattattgggcccatttcttcaagaattttttcctgatcagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttcttt

SEQ ID NO: 3635 - DNA, 2798 bp, Homo sapiens
agcagactgggctgcgggcggcggggccggcgcctgcctggagggatggggctgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtctacttcctcagcagcaccttcaagcaggaggagagggcagtgagagataggaatctcctccaggttcatgaccataatcagcccatcccgtggaaagtgcagtttaacttgggcaatagcagtcgtccgagcaatcagtgccgcaactccattcaagggaagcacctcatcacggatgaactcggctacgtttgcgagaggaaggatttgctggtaaatggctgctgtaatgtcaacgtccctagcacgaagcagtactgctgtgatggctgctggcccaacggctgctgcagcgcctatgagtactgtgtctcctgctgcctgcagcccaacaagcaacttctcctggagcgcttcctcaaccgggcagccgtggcattccagaacctcttcatggcagtcgaagatcactttgagttgtgcctggccaaatgcaggacctcatctcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatccaggctctttcactgtaaaattatttattggattcctttggagtaatgggaacattctaatgttttatgtaggaaaatgccttgccattctagttgaatatgttcaaggaagttatttttgttgttgttctgtgttctcgagtttcaggagttaaatcattcttccacccagatacaacattttctcttttaggacgtgaatattctctctaggcagttatttttgtttgtatttcgacagtatcaagcataggccctgaacgtgacctgttagccatatcctgacgtgtaaaattatctaaaaactcagacactcttccattctaatctaactgcacgatttctaacagtgggcaccatgtgcctgccctcaggttattttccagtggtagtcgaatgtgctcatataccctatggagagcactgttttagcagaaatctaatttctcttcctggaggaatttgttctcatttcttttgccacttaaaattaactgtgggctactcagccagggtacagtgggagcctcaggaaggtcagaggcaacctcctcccctgttctatcaatagaaacccaacgttgaggcaattcctaaacagacgcacctcgtagcttgctgtatgtgtttattctttattgctttcagctttggggctgtaacaggtacaaatatttggtttccctatgatttatagagaagaagaagaaacccagctttctatcagagcactgcaagagaagagtcttacacctgccctcagtgggagatgagaatggtcattatgacttagagaatgctacacgtgtaggttgctggtgtgtcctgaatccacaggcataaagcactccccatttttcctactgtaatgcagattctccggctcaaggtctagaatatttgatcctaagatcaagacatcatgcccttcgaatagtactgctctttgttttcaggagtcacgtgaacacacaactctcctatattcctcacaaacctcaggattgagcaaggtctttgtaatttttttggttcactttattgacctgggagcaaggtgctaattctgtggtcagtattcaatgtttttttcagtggagctttttctttgggccatatttgccttctaatacattcctgcaatatgtagtggtgatttcccttagcttcctcctactacctcttatactcatctccccaaattatttgcctcccttaaataagttttcctagaaggtaagctggtcaggcaatttgaaaaatattagatcccaagaaatctattccgtttgcattggacttctcggattccatgtgtttgcagcaggactacatcgaactctgatgtgccggattgtggcatgtctgcatgtctcatccatctattgtttttggtaactcagtttggaatttcagtgtctgtcttccctgggttgacattggaatcagcctctcctttgagcttattttaactcttgagcaacataacatagatttaatgtgaacagtttataccaaagggcagcctgtgcctgtttatggatcctctctgcctttgtacttgaagagcgcattttacatttccagtcctttcacagacaggagctccaaccttacgatggagaattaaacttgcttgtatttccactttgtggatgagaaaaaaaaaaaaaaaaaaaaaaa

SEQ ID NO: 3636 - DNA, 2993 bp, Homo sapiens
atgcagctcggacgcagcggaaggagaagccagaagcagaaacatgaggtagacgaagtgtactttacacttacacgggtggaccgcagctgtccatacctgacagtgcctggccctcccggagccgaatccggtgctcctgttcgcctggggctccgccagcgcgccgtaagctcctccagaaacccaaattctgcaggccgcacccccaactcgtatctcacccaggcccccgtctggcgccgatctgccccagctcaacctccggctccgcagactaggcactttccgggacgcggggcagaccctgcgctcgggtcccttcccgcagccgggctgtccggcctctgcgcgcgcacaacaggcggcacggcgcagcccccgggagcgcgggactcgggtgctagtcccggcgcccagccacagcgacacagacctggagtgagcgacctccgactcacggagaagcgaccttaccaccggtgcccgacacccagagctaagggagcgagaagaaggcgaagaaagaggcggagagcggtgcactgccttcgctgggactcgcgacttccagaaaccctcccgaaacccagtcccgccgccgccccgccggcagggggcacagcgggcgtccggggcgcggcggctgagcgatggggcgagcggaaagggcccagacgcctggttcttgttcatacctcggagaaaaccccgcccccgacccgccccaactggccgcggcggcagccgagccgcgggagctgcgcgctgagctcgcggcagtacggggagcgcccgcccgccccgccctggacccaaccaagcgtcccgcggaggggtgcggccacttgggggcaggagaaagcggagtacgccacccctctagggacccaggaagcgaggcgagcctcaggtggacgcggtggtgtggaccacggcgatcagggcctttccccctgctgtggagacggaggtgcgaggggacgccggcggctccccaccttctggccgagtggccttctccgcctccggctggactccctcggggcgctccctccagagccgagtcgggctggccgggggcggctgtttggcctgagtgtcgtcttactaaagcggaacgccggaggggaggccactccgagagaaggcggtccccggcggaggtggcttcgtgaatcctgcagccccctgcccgcccgccactcgagacgccgcgcctcgtgggtttcacgctggatggagggggcgccgccgaggatgcccagcctccccctctaattctacctctccagttcctcaggtagacacagcctctgtctgctgtggttttagtgcccatggcccctcagaaattatttttgtcccctcccgatagtggctttgggggatggagggcgagagatgcaaagggccagtggaagattttttatagcacaaggaatcaagccaggagatggaggtttcattgccacctcggggtctggggagggggcgagccacacctctccggtcagtctgcgcccaccaggacctgctgctgggaaccgcacacgaaaggagagacacccagcacctggcccctagacccgcagggcgtcaacctcctgggcttctgcctttctaggtttcctctgactttgctgacccaatgacccctggccacgggtggcaaaaacgccctcactgagcccttcgctaaaggagtgccggggtttatgtgtctggcttttaaaatgggatgaggagacaaggaaacaggacctgagaaaggacactatccaaaatctgatgctctcagaagtcaactttaaaactgccctgctccgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaactgccctgctcttttcatccaaagatgaatatatgaagccagctgttactggttgaaagtgtgcctcttgtttgcatggcaaaggaattcagttttgtgtttatttacagctgaagctctcttgaaataattgtctcagtcacagcttttacattttggggaaccatgccattagaactgaatattaggaactgtgatcttttgtcttttcacaattgacaatacattcagaacttatttctgataaaactgggcagtttctaaggatactgtacttatgatttaaagtcataactccatgatgcaaaagagaacaagaaatatgtttcaatgactgccttttaaattagcggtactccagcactttgggaggccgaggtgacaggatcgtttgaggccgggagttcaagacagcctgggcatcatagccagaccttgtttctactaaaaataaaaaataaataaattttccgggcatggtggcccatgcctgtagccccagctactcaggaggctgaggtgggaggatggcttgggcctaggaggttgaggccacagtgaattatgattacaccacgggactctagcctgggtgacagagtgagaccctgtctgaaaaagaaaaaaaaaaatgtagctgtacttaatgtactaaagttaaaaattggataacaatagttgaggacagtgtaggcatttaaaggtagaggattgcactttttttctcatttttgtcttttatatgcatcagaatgagtgcatattgtatactacttggtaaggtcttaaattaatttggtacctactgagataatccggcatttcatgtgtaaagataaattagataaatgaataatatatcactatctt

SEQ ID NO: 3637 - DNA, 2992 bp, Homo sapiens
atgcagctcggacgcagcggaaggagaagccagaagcagaaacatgaggtagacgaagtgtactttacacttacacgggtggaccgcagctgtccatacctgacagtgcctggccctcccggagccgaatccggtgctcctgttcgcctggggctccgccagcgcgccgtaagctcctccagaaacccaaattctgcaggccgcacccccaactcgtatctcacccaggcccccgtctggcgccgatctgccccagctcaacctccggctccgcagactaggcactttccgggacgcggggcagaccctgcgctcgggtcccttcccgcagccgggctgtcccgcctctgcgcgcgcacaacaggcggcacggcgcagcccccgggagcgcgggactcgggtgctagtcccggcgcccagccacagcgacacagacctggagtgagcgacctccgactcacggagaagcgaccttaccaccggtgcccgacacccagagctaagggagcgagaagaaggcgaagaaagaggcggagagcggtgcactgccttcgctgggactcgcgacttccagaaaccctcccgaaacccagtcccgccgccgccccgccggcagggggcacagcgggcgtccggggcgcggcggctgagcgatggggcgagcggaaagggcccagacgcctggttcttgttcatacctcggagaaaaccccgcccccgacccgccccaactggccgcggcggcagccgagccgcgggagctgcgcgctgagctcgcggcagtacggggagcgcccgcccgccccgccctggacccaaccaagcgtcccgcggaggggtgcggccacttgggggcaggagaaagcggagtacgccacccctctagggacccaggaagcgaggcgagcctcaggtggacgcggtggtgtggaccacggcgatcagggcctttccccctgctgtggagacggaggtgcgaggggacgccggcggctccccaccttctggccgagtggccttctccgcctccggctggactccctcggggcgctccctccagagccgagtcgggctggccgggggcggctgtttggcctgagtgtcgtcttactaaagcggaacgccggaggggaggccactccgagagaaggcggtccccggcggaggtggcttcgtgaatcctgcagccccctgcccgcccgccactcgagacgccgcgcctcgtgggtttcacgctggatggagggggcgccgccgaggatgcccagcctccccctctaattctacctctccagttcctcaggtagacacagcctctgtctgctgtggttttagtgcccatggcccctcagaaattatttttgtcccctcccgatagtggctttgggggatggagggcgagagatgcaaagggccagtggaagattttttatagcacaaggaatcaagccaggagatggaggtttcattgccacctcggggtctggggagggggcgagccacacctctccggtcagtctgcgcccaccaggacctgctgctgggaaccgcacacgaaaggagagacacccagcacctggcccctagacccgcagggcgtcaacctcctgggcttctgcctttctaggtttcctctgactttgctgacccaatgacccctggccacgggtggcaaaaacgccctcactgagcccttcgctaaaggagtgccggggtttatgtgtctggcttttaaaatgggatgaggagacaaggaaacaggacctgagaaaggacactatccaaaatctgatgctctcagaagtcaactttaaaactgccctgctccgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaactgccctgctcttttcatccaaagatgaatatatgaagccagctgttactggttgaaagtgtgcctcttgtttgcatggcaaaggaattcagttttgtgtttatttacagctgaagctctcttgaaataattgtctcagtcacagcttttacattttggggaaccatgccattagaactgaatattaggaactgtgatcttttgtcttttcacaattgacaatacattcagaacttatttctgataaaactgggcagtttctaaggatactgtacttatgatttaaagtcataactccatgatgcaaaagagaacaagaaatatgtttcaatgactgccttttaaattagcggtactccagcactttgggaggccgaggtgacaggatcgtttgaggccgggagttcaagacagcctgggcatcatagccagaccttgtttctactaaaaataaaaaataaataaattttccgggcatggtggcccatgcctgtagccccagctactcaggaggctgaggtgggaggatggcttgggcctaggaggttgaggccacagtgaattatgattacaccacgggactctagcctgggtgacagagtgagaccctgtctgaaaaagaaaaaaaaaaatgtagctgtacttaatgtactaaagttaaaaattggataacaatagttgaggacagtgtaggcatttaaaggtagaggattgcactttttttctcatttttgtcttttatatgcatcagaatgagtgcatattgtatactacttggtaaggtcttaaattaatttggtacctactgagataatccggcatttcatgtgtaaagataaattagataaatgaataatatatcactatctt

SEQ ID NO: 3638 - DNA, 781 bp, Homo sapiens
gtcacacccggaagcaggggcccgagcggagccggccgcgatgagcggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaaaaaaaaaaaaaaaaaaaaaaaaaaaaa

SEQ ID NO: 3639 - DNA, 3434 bp, Homo sapiens
agtccccacagctgcgccggtgactgaggggccgggcagtggagaagtggtggcggcgggcggcgggcggcaaaggagcagccatgagggccgggcccagtcaccgaccgtgctgaggagtcatggaagagtttttaaaccagtgtgagccactgccccatgttgtgttgatgccaatctgccatgctagcctgtctaccagggccaggtgacctgtcctttcagcctctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccggcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattctgcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcggaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtagattcaccctctagtgcagcccctcagtttaatgaaggaaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgcc

SEQ ID NO: 3640 - DNA, 2173 bp, Homo sapiens
ccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagcctttgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaa

SEQ ID NO: 3641 - DNA, 1171 bp, Homo sapiens
gggagaggggaagcagatctgaggacatctctgtgccaggccagaaaccgcccacctgcagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagccccacgggccttccacctccctcagcttcctgcatggacccaccttactggccagtctgcatccttgcctagaccattctccccaccagatggacttctcctccagggagcccaccctgacccacccccactgcaccccctccccatgggttctctccttcctctgaacttctttaggagtcactgcttgtgtggttcctgggacacttaaccaatgccttctggtactgccattcttttttttttttttttcaagtattggaaggggtggggagatatataaataaatcatgaaatcaatacataaaaaaaaaaaaaaaaaaaaaaaaaaaaaaaaa

SEQ ID NO: 3642 - DNA, 774 bp, Homo sapiens
aagatcatggccactaactacagtgccaaccagtatgaaaaggctttctcatccaagtatctgcagaactggtctcccactaagccaacaaaagagagcatctcttctcatgaaggctacactcaaattattgccaacgatcgtggtcatctactgccttctgtgccccgttccaaggcaaatccttggggttccttcatgggcacctggcaaatgcctctgaagataccccctgctcgggtgaccctgacctcccgtacaactgctggtgctgcctccctcaccaaatggatacagaaaaatcctgatttactcaaggcctccaatgggctgtgtcctgaaatcttaggcaagccccatgatccagacagtcagaagaaactcagaaagaagtctatcacaaagactgtacaacaagcacgaagtccaaccataattccaagctccccagctgccaacctcaattccccagatgaactccaaagctcacacccctctgcaggtcatactccaggtccccaaagaccagccaaatcctaagagcccacctggaagtccacgtatgctagaactctgggcagggcctaatctagctgaggtccagaaatacaaacctggaacttcatatggaccaagtggccacacactgaaaaacccgtatagcgactcagtgaaataaacaagagcccccagtcagaactgtgaaacagggaaattttggggtgggagtaaaagcaaatttggaaaataaacttttttttgttgaatctttta

SEQ ID NO: 3643 - DNA, 4094 bp, Homo sapiens
gagctcggcgcggagcccggagcccgcagccgacagtctcctgctcccgtacgctgggcgccagctccggccgtgctgcccggctgcctgagagcgcgcccggccatggagccctcgcacaaagacgccgagacggcggcggcggcggcggcggtggcggcggcggacccccggggggcgtcctcgtccagcggggtggtggtgcaggtccgcgagaagaagggccccctgcgcgccgccatcccctacatgcccttccccgtggccgtcatctgcctcttcctcaacactttcgtgccgggactggggacattcgtctcggccttcactgtgctgtgcggggcccgcaccgacctcccggacaggcatgtgtgctgcgtcttctggctgaacattgcagcagccctcatccaaatcctcactgccatcgtcatggtgggctggatcatgagcatcttctggggcatggacatggtcatccttgccatttcccaaggctacaaggagcagggcatcccacagcagctgtgagcccacgggagccgctggggagatccaggggggccctgtgagggctgcaccaggcagctttgggcacaaggacctttacatgttcttttctgccattttctggactgggggtggaaagggggtatttttaaaaatattatttattttgaaaacgcatctgcttttctcagcaggttgtgagggctgccagcccctcctgctctggaaagcactgtgggcgcaggcaccagagcatcagagagtggggtggagatgagaacgcccacagagaggctgggatgctccggcaggctccaactggccttgctgtacccactgcccaccgcaaaggcacgccacgtctgctgggccgggccacaccgggccctgtctgggtgagcaggggctcaccaaggggacaggactgtggtagacccgtcctgtgggaccccacctgcctcaaaatctggtgccccgagtgtttactgtgtggtctcctgggggcagcaccagggtgtgggtgaggatggccaggctccaccctagcgtggaaaggcccactgtgcccacagctggcctgaggcctcggggagaagaccagtcccacaggcgtctcctgggcctgcctccctgaccgcaccccccgcctcctcgcagctgaaatctgagggctgggtgtgtcgtgacctgtgttttcctgggaaggagaggagtagctccttccctggggtgaaactgccagatgtttatacacaaagttattagactgaagcaggagtgggcagactagcaggctttcacccaatacttaacagcatttctggcccacattcctttttctgaagtcattggggccagatgtgtctccgaattgagaaattttagatttgagaaagacaatgcgatccatttatcgtacactttctaacttcccggcagagtgtggaacatctcgcctaccatcaggcacgtgaatatttctgcagagaaacatgtgactagtcccattaactgggagctatacaaactgtaaatagcctcacctcagttcagtctaattttgccactaagtaacttagggaaaaacttaccatttgagagcttttagggtttcagaattgcaagaacaattgtatggggttgtggaccttgatctgaaaatcctgcttgcaaacagatgtgttagagggtgaaattgtcggcattacacaaggactccttcagttgccaaaagaccatgggcctctttaaggagcccctctgtaagtgattgggacagggctagatccctaatgggggctaggggtggggagaatctagcagaagttgtccaggatactgtggatcaagtatcaatctgaaattaagagaaattagatactaagaggatggacatttacatgtctgtttcctttcctttcattttcattctaacataggaaatgctaacagatggggctggcccaaagtcaagcttctgactccacttgacacagtgccattgggcatgtccctctctgaagggcttgtttgtctatcagagactgtcagaactccatgagggcaggagaagggattttgcaggatgaaagtgcttgggaagtagtggccaccgttctgggggtttcagcccacctaccccatccaccgggctttctaatcacagtcctgcctgagaagcgggccctgctgcccaccccttatcatggatcccttagctactgtccgtcttccattgctgcctggggctgggctgccgtttttgaacacctggcagtgtctttgtcgcgtcctgtcctctcttcttacagaccccaacccaggcctttgccttcttctctcctgtttggaagcctctgtatcttcaaggtgtgggaacagatttggttttctctaaaaagctagaaccttctgctgtgtgcagcaggcatcctccaggctggtgctggctgctctcgaggaagctgcgtcagagtggagctgcccctctactcagataaaatagcttcagctgcaggaagccgccccctcccatgcccaccagcccacagcccttcaccccacacagcccccagagtttgcccgacaccccctgagtgatgacgggtctcaggggggggccgcccccacagatgggaggcggaggcttgttttccccgcttgggctgggggcggctgctgagggggtgaagaagagatggcaatttgtgtcgcatgtttggtgacacaatccagatgcaggtgggactttcttgagtggcaggtgtcaccctgggtcccgtgtgggatggtttaatacaggggtttgtgtgtttgtgtgtgtggagggccactgcgcccccagatcctcctctcccccgagggctgcgtctctaaacctgggaaaacatcagcctcaggaggaggcccctttccgggtaactgatgtgtgggagaagccaagaggcccctgcctgtctcctgaatgaggctgtgagggttgccatgtgggcgggaccggttcaaaatagcgcccccgcccctctaaattagaccgtggtctcagcatgatcatcttcagtagataagggacagtggctgatttactccaaatagttccagctggccactcagaccagggccagagttaacttctcaaacaccagccagctgaaaattagggttctcgtgcaggcaagtgcatggttgacacacagccctttggtgacaaagctgggctttgcctgcatagtgcagacaaggctgttggttcagaggctgcagggcacattccaggttggggccttttgtcggtcggaattcaataggacattccctggctgtgggtgtttagggcaggaattacaggcttgcagagaaagtcagaggcaatgagatgctcccagtgccaaactgtgacactgggatcagggtggtcattcccttgggtcagagtgggaccctagagccggagtgagctgtgggtggcctgggtgtgtcctgtggacggcggagactgttgatttggatgttgagctctgagtcagtttcagaaccaaggatctcaggctgagaaggccaggtccccatgggagcggcaggagtctgatggctctgctgccagagcctaccccagcctgccacgccgctgaccttcccatggtaaggaaggggcaggcagcatggttcccaccctcagctgccccagacccacacatccagccccaagagcagcctcacccaggcacagtgcagggcattttagctcctgggaggggagatgcctttgtgagtttcagatgtcagaggagaagctccgagagagtaagtcatgtgcccccaaacactcagctcctaagtggcaggacaggcaagtggccaggttgggccgcccccacagcctgtgccgtccacacactcactacagcactcccagaagaaggagcagaatcgcatgcagcccagagcaggtcctgtggaggggtcctcacccctcaggagtaatagggtgattatgtcacatgtttagtgatacaatcccacctgtgtctggattgtgtcactaaacatgcaacatggattgccatctcttctccatcccctcg

SEQ ID NO: 3644 - DNA, 3291 bp, Homo sapiens
aacccgggcggcggcgaaggaggaggcaagaggcgagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagccccgatgtgcctggcagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgt

SEQ ID NO: 3645 - DNA, 3106 bp, Homo sapiens
tctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaaaaaaaaaaaaaaaaaaaaaaaaaaaaaaaaa

SEQ ID NO: 3646 - DNA, 1091 bp, Homo sapiens
cgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaaaaaaaaa

SEQ ID NO: 3647 - DNA, 961 bp, Homo sapiens
cgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcagggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaaaaaaaaa

SEQ ID NO: 3648 - DNA, 1202 bp, Homo sapiens
cgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcagggaaaggccattgctgctctggagctgtgtgtgtgtgtgatgactaaagcaaagaagcagccctacagtggcactcctgggtctggtgcaccactcctcaggagcatctcagattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaaaaaaaaa

SEQ ID NO: 3649 - DNA, 1072 bp, Homo sapiens
cgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcagggaaaggccattgctgctctggagctgtgtgtgtgtgtgatgactaaagcaaagaagcagccctacagtggcactcctgggtctggtgcaccactcctcaggagcatctcaggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaaaaaaaaa

SEQ ID NO: 3650 - DNA, 1521 bp, Homo sapiens
gggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgagtcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaattgaattcgatgactcttggtgaggtagagcaactgaatgcaaagctcctacagcaaatccaggtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactctagtcttctagggctaatcattttggctcatttggggactcttttttcccagaattactaaacaaattttatcacatgtgactacttaaatatactgttacagtgtcattttattaaacattttaattcacctgtcaaaacaacagattaactccttagtgtaaactactagagataatttttaagagggaaatggaattcatatcacctcttatttattatgagcaatattttaatataaaaattttatatgtgaaaatgctattttaggtactttgccattctctttataaatgtgtatttgagtggttctgtatatttatttacattatcatgtgtgaatatgttcacccatatttcaggtcactgcattttattctcttaatacaatgttttcacaacggttaccttgctttccaaagataaatatattttggattagaaaaaaaaaaaaaaa

SEQ ID NO: 3651 - DNA, 2955 bp, Homo sapiens
gcgacggaggtaggcttacgaggcctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagggaaaaattggaagaaaaagccaaattatatgaaaaaatgactaaaggagactttatagatgaagaagtagaggatatgtaccttgtggatttcacacagaagatcatagacaagcgcaaagaaatggaggcatctggtgcccatagagattctcaaaaggcaggagaaagggacgacgatgaggaaaaccttcctgagggagagatccctcctccccaagaccccagtgaagaatgggtggattacgtggactctttggggcgttcccggcgctgtatgagaaaggatttgccagatctgctggagatggataaaaatcttcaggggagactttttattagtcctgctaatgaaaaaaccctattatctgaagatatgagaaaagaacttcagcgccagcaatgggaggaagaagaaagagaggccctgaagaggcccatggggcccgtacattatgaagacattcgggaaaatgaggcccggcaacttggtgttgggtattttgcctttgcccgagacaaagagttgagaaacaagcagatgaaaaccttagagatgctgcgtgaacagacaacagatcagagaacaaaacgagaaaacataaaggaaaagcgaaaggctatcttagaggcaagacttgccaaacttcgacaaaaaaagatgaaaaaatcaaaagaaggtggaacagaagaagaaaatagagatggagatgttattgggcctttgccaccggagccagaggctgtgccaaccccacgtcctgctgcccagagtagcaaagtagaagtcattgtccaggagaggaaggacaccaagcctggagtgccacacatccgggagtgggaccgcggaaaagaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatccgagcatgcaggtgtctttattccaagggttcagcttccagatcagccgatggaccataggtcacgaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctacactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcaggtgggttcccgtgtcattagtaataaggagagggttgggggtgggcagggctccagaaagtcagcagtgtgcctgggcacccaccccatcctctacctgccacacctcagagggttcctacagctgcacacaagcagttgagagttgatgaccaggcccatagggctcccacagctggttcccaggccagtgagtgctgtgagaatacagtagcacaagtccttgttctctgaagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaaccaaaaaaaaaaaaaaaaa

SEQ ID NO: 3652 - DNA, 1401 bp, Homo sapiens
cgctcgccgggacctggaatccctgtacgccgaggtgggagccggtggaccggtcccccagccggcccccacctccgcttcccggtgtttgagggttcgggcctcccgccggggagttcacccctcgggctcgtcagtagggctgtggctgtcgcctcttcctgcagcgccaggctccgcccggtctcacagtcggcttaggggctttgcgtgcactgcggttgggtggaaaaacccactcctggttgtttagacgttggcctgcagacgatgtcatttctgtattcctctaaggcaggaagtcattatgcaacttacacatattcatcagatttcctctgacttacccggacatgtacgtgggaatgatgtgcactgccaagaaatgtgggattaggtttcagcctccagctattatcttaatctatgagagtgaaatcaaggggaaaattcgccagcgcattatgccagttcgaaacttttcaaagttttcagattgcaccagagctgctgaacaattaaagaataatccgcgacacaagagttacctagaacaagtatccctgaggcagctagagaagctattcagttttttacgaggttacttgtcggggcagagtctggcagaaacaatggaacaaattcaacgggaaacaaccattgatcctgaggaagacctgaacaaactagatgacaaggagcttgccaaaagaaagagcatcatggatgaactttttgagaaaaatcagaagaagaaggatgatccaaattttgtttatgacattgaggttgaatttccacaggacgatcaactgcagtcctgtggctgggacacagagtcagctgatgagttctgataccaaacactcaaaacatgcattgggctagcagaatatccatgtttattaccagactggttctggaagaagctgtaaagaatactaaatatgttgggttataggggattgaccatgttacttttcaaaaccaggacatttaaagcatctactatgtaggtgcatgaggagtatgggaaaaacagaataaaggaatctgcctttaaggagcttacaatcatgccgggtgcggtggctcacgcctgtaatcccagcactttgggaggctgaggcgggtggatcacctaaggtcaggagttcgagaccagcctagccaacatggtgaaacctcgcctctactaaaaatacaaaaattagccaggcgtggtggcgggtgcctgtaatcccggctactcaggaggctgaggcaggagattcgcttgaacctgggaggctgaagttgcagtgagccgagatcgcgccattgtactccagcctgggcgatgagcaaaactccatctcaaaaaaaaaaaaaaaaaaaaaaaaaaaaaaaaaaaaaaaaaaa

SEQ ID NO: 3653 - DNA, 1809 bp, Homo sapiens
gcgagctgacagaggggagcagaggcccgagcggacgcgaggcgacgcggagagggcggcctgggccgaagtgaggcgacgcggggcggcggagtctgagggccggagcggagcggaggcgacgcggggaggggcgagggatcgcggccggtggctgggggccacctgctccccgagcaccggcccccgctccggggagcagagtccggagcgggatccgcggcccacaggttcgcaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaaaaaaaaaaaaaaaaa

SEQ ID NO: 3654 - DNA, 1638 bp, Homo sapiens
ggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaaaaaaaaaaaaaaaaaaa

SEQ ID NO: 3655 - DNA, 2931 bp, Homo sapiens
atgcgaggctggggccggttgcctaccggccgcttctcgccgaggcagtccagacttttcccccggcggtgcccgctccaagacagcatctgtcaacgctcctcttctcccctcctcctcctgccgggccgggctccgccggctgcggccgagaggacgcgggacccggcgcggtgagcccatcagctgtcaggcgagcggcgaagcggctggagggcggcgagagacacacaaagaacgcggtgggcggcggcggcgaaaggggacggcaactcctccccgcgcccgccggtgccaccgccggccgtgcttgttccgaggccgcgcagacaatgcggccgggctcgtccccgcgtgccccagagtgcggagcgcccgcgctcccccgaccccaacttgaccgtctcccggctcgcccagccccctcccggggtaggggcgccccctccctccggtggccggcgaaggaagtcggtccgcggccgcagatcccggcaacttgcgaaccgggaaaagtttgcggcgcctccgcggggcggcgcgacgcgtcccgcccctcgcgtccgcggtcatcgcgggtgactttctcgactcgtcgtcagccggggccgcagcgcggccggtggggactgcggggcgggccggagtccgtccgaggtctcccgcacctcgggctgcggatttcaggtactccactgggcattttctcttcatggagcttatagcaacaaaagtgttttacaaaacaccagacatgttggcatcatctcttagttgggccatgtggccagggaacccttcatgaaaccacctctgcagtcctggagagttgctgtagaagaaggaaaagagaggaagacaacacaacacaggaggggataagtacctctggacacaatggaagtagtagttgttgagcagagggaaagggataggagaaggatgtggactgcagtgctgcagtgccaggtaataactttgatcatgtacctccttggctcaggtgctgtctcttctactctcctccttacttgtactaccttatttagcacttaattatatactttcttgactcactttgagacacactgattatgtggtctgcctcaaagacagaatcctagttttggattttagcattactgatctatagccttgcaggggcttaaggatggcagctgtctctctcccttgggatctagcttttgcaaatattgaagggaagagatttctttgatcttataggaatagatccacagttcctctccagatttgcttttatagagaagtgtgtgtcaccaaaacaatggagatacggtcagagaggcccctacccccagaattttaatataattttactttctggggcatttattcttgacaaatactttctctcctatcagctcacttgttcctcacaaaaaccctataagatattaatattattaaacagacccctatgaagcacctcaagtctttctctcttcccacttccattcttgcacaccttttgctagactagtctctgcgttcatcacatcaggtttctaaaataaaagtcccctaataactttctatttgttctctcatcatattgaaccttttttgcctggcttataaggtggccttaaaaccccattttcctctaaacattgtctctgtagttcaggaatatggcaggctcaacactatgcttgagcccatattgcttccctcattagtgatgcctcctctcagaccacccagattctactcattcttcaatttccagcttctccttggagcctttccagatcattagcttcttaaaaatcccagctttctctgaattctgatggtagcccccgttatttggacaattatgtcctggtcttaaagtcctaatgggaaaaaaaagtacatgatggacttcatgtagagaagaaagcactggactgagttttaagacagctgctaaggagctgtgtgagccaaaccaggttactttacctctctggatctatatttgctgatctgttaagtggagacaattgggtcagataatcttggtggtctttgcttattctgaggttcttgtacaacttggcctagttcacgtgggatgggattgaagatcttactgagttcttggatggaaatgtcagtaatgggcacttagtgccttcaggacttgttctatactatcccagaaatttctgatgctaaacttggcaatttttaaatgtcatattccttttctccaaactctttaaccacaagaattcagggaaggttatggggggtgacttagttatctggataatacatattgtggacaatatagcattatccttgggaatgatttcatattgttgaataaataggatcaacttcttgataaaccttagtcccaagcatttcatcttcattggatagtgttacatagtaatatatttatgttttcttttaatcatttcataacttggaatactaacatagtcaaaactctagggtaggtgatacatgagtttctgtagtaatctggttggagacatgttgtaattctgtatatatatgtacatttatcccatgcatgttatgcctaaactaagacggatacccctgaattaagaggtgctgttatacattgaccaggcttaagaatatctctttaaagtgtgtcgacatttaattgacctttggaagttcattctgttaatcatactcaaagtgctaaagctatggttgactgctctggtgtttttatattcattcgtgctttagcatataaattcttcagcataattgctacttatttagcaagagtttcctttatttgaaaatgtgagttgtgcttgtatttttgtgtctttctttctttctttctttttttaaactttgcttcaggctgggtagtggtagaggtttgaattaaaatgttttcctgtcagt

SEQ ID NO: 3656 - DNA, 4269 bp, Homo sapiens
gtttgcggtttagaccccaaagattcctgttggtggtctgggtcacaggaggcaggtttcgggagctggaaatgtgagcgggtacgacaggcaccgcgggtaaccgacgccccgggtccttgctgcagccgggtacgcgggataccggcaccccgccttctccgcccgagtgctgccaggcgtgggcctggaatctcttcacaccttctctttggagcccttaatgatacgacgaaccccaagtgtttcagaacatgaagtaaacaatggagaactgttctgctgcatcgacgttcctgactgacagcttagagctggagctggggacggaatggtgcaaacctccttacttttcttgtgctgttgacaacagaggaggaggaaaacatttttctggagaatcctacctctgcagcggagcccttaagcgattgattttgaatcttgaccctttaccaactaattttgaagaagataccttggaaatatttggcattcagtgggttactgaaacagcattagtgaattcatctagagaactctttcatttattcaggcaacaactgtacaacttggaaaccttgttacagtccagttgtgattttgggaaggtatcaactctacactgcaaagcagacaatattaggcagcagtgtgtactatttctccattatgttaaagttttcatcttcaggtatctgaaagtacagaatgctgagagtcatgttcctgtccatccttatgaggctttggaggctcagcttccctcagtgttgattgatgagcttcatggattactcttgtatattggacacctatctgaacttcccagtgttaatataggagcatttgtaaatcaaaaccagattaagctttttccaccgtcatggcatttattacatctccacttggatatacattggctggtgctagaaattctttacatgctgggtgaaaaattgaaacaagttgtatatggtcatcagtttatgaatctggcaagtgacaatttaaccaacatcagcctatttgaagaacattgtgaaactctcctttgtgatttaataagcctgtcactcaacaggtacgacaaggttaggtcttctgaatcattaatgagtgaccagtgtccatgtttacgcattaaagaattatgggttctacttattcatcttctagaccacagaagtaaatggtttgtctcggaatcattttggaactggttgaataaactacttaaaacactgcttgaaaaatcaagtgaccgaagaagatcctctatgcctgtaatccagtccagggatccattaggttttagttggtggattattactcatgtagcatcattttacaagtttgatcgccatggagtaccagatgaaatgagaaaagtggaatcaaattggaactttgtagaagaactgctgaaaaagtccatcagtgttcagggtgtcattctagaagaacaattacgaatgtatcttcactgttgtttgacactttgtgatttctgggagccaaacattgcaattgttaccattttatgggaatattatagtaagaacctgaatagttccttcagtatttcttggcttccttttaaaggccttgctaataccatgaagtcacccttgtctatgcttgaaatggtgaagacttgctgttgcgataaacaagatcaggaactatataaatccagcagtagttatactatttttctttgtattctggcaaaagttgttaaaaaagcaatgaagagcaatggccctcatccttggaaacaagtcaaaggaagaatatattcaaaattccatcaaaaaagaatggaagaactaactgaagttggtctacagaacttttttagcctttttctactgttagcagctgttgcagaggtagaagatgttgcaagtcatgttttagacctcctgaatttcctcaagcctgctttcgtaatgtctcagagagccctcatttggaagggtcacatggccttcctcttgatgtatgcccagaaaaatctggacattggtgttttggctgagaaattttcatgtgctttccgggagaaagcaaaggaattcttggtgtctaagaatgaggaaatggtacagagacagactatctggacccttctttccatatacattgatggtgttcaagaagtgtttgagaccagctattgcttgtatccttcccatgaaaaactgcttaatgatggatttagtatgcttctgcgagcatgtcgagaatctgaacttaggacagtattgagcttcctacaagctgttctggccagaatcaggagtatgcatcaacaattgtgtcaggaacttcaaagggacaatgtggacctatttgtacagtcttcattatcggctaaagagcgccaccttgctgcagttgccagtgcactgtggagacatttcttttcatttttgaagagtcagagaatgtcacaggtagtgcctttctcacaacttgcggatgcagctgcagactttactttgctagcaatggacatgccaagcacagctccatcagattttcagcctcagccagttatatcaattattcaactttttggttgggatgatatcatctgccctcaagttgtagcaagatatttaagtcatgtcctacaaaatagcacattatgtgaagcactttctcattcaggctatgtatcttttcaagccttaaccgtaagatcatggattcgttgtgttttgcaaatgtatattaaaaacctctctgggcctgatgatttgctcatagataaaaatctggaagaggcagttgaaaaagagtacatgaaacagttggtcaaactgacaagattactatttaatctctcagaagtaaagagtattttctcaaaggcccaagctgaatatttatccatctcagaagaccctaaaaaagcacttgttcgattctttgaggctgttggtgtaacttacgggaacgtccagacactttctgataaatctgccatggtcacaaagtccttggaataccttggtgaagtattaaaatatattaagccttatttgggaaaaaaagttttcagtgcagggctgcagctgacttatggaatgatgggaattcttgtgaaatcatgggcacaaatctttgccacttctaaagcccaaaaattactattccggatcatagattgtttactgctgccacatgcagtattacagcaagagaaggaactgcctgcacctatgttgtcagcaattcagaaaagtcttcctttgtatctccagggcatgtgtatcgtgtgttgtcaatctcaaaatccgaatgcctatttgaatcaattgctagggaatgttattgagcagtatattgggcgatttcttccagcttcaccatatgtttcagatcttggacaacatcctgttttgctggcattgagaaacacagccactattccgccaatatcatctctaaagaaatgcattgtgcaagtcataaggaaatcctaccttgagtataaggggtcctcacctcctcctcgcttagcatccattctggccttcatcctccaactcttcaaggaaactaacacagacatttatgaagttgaactactcctccctggcattttaaaatgcttggtgttagtcagtgaaccacaagttaaaaggctggccacagagaacctgcaatacatggtaaaagcctgccaagtggggtcagaagaagaaccttcctcccagctgacttctgtgtttaggcagtttatccaggattatggtatgaggtactattaccaggtttacagcattttagaaacagtagcaacattggaccagcaggttgtcatccacttgatttctacccttactcagtctctgaaggattcagagcagaaatggggccttggcaggaatatagcacaaagggaagcctatagcaaacttttgtctcaccttggacagatgggacaagatgagatgcagagactggaaaatgataatacttaatatattttgtgattcatcctgtctattaattatcagtatctaaagccacattgttccactctaattcctacttttaattaattgtataatgttctgtttaaaataatttctaggattttttttccttttatatctgtaagtaaaaaatgtataaataaggaactgaaggttaattagcaactgtgtaataggatccttggaactttttacaaaactgcattctaccttgatgaaattttagttaaactaaattaaagaaacattttctgag

SEQ ID NO: 3657 - DNA, 1748 bp, Homo sapiens
ctctgagtgatgggcctactgcagagcccgcctcccaccacagtgctggcccagaattttttatacgaactagttcgtaactaaacgttggaagcatcaccatattgccagtgagaagcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagactgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaagtaggtttttctaataaagttgaattaggtcaacaacatttcctcagcatataattatttgtctgtcatttaccctgtcaggtgtcatgccaggttatgtatacatttatgtggaggtgattaattttgtagtaacttttgagaagccctctgctgtctgcagaaatccaaggattttctttgaggatagaaatgctcttgtatatctttctaacaaatagtaaaatctttaaaaaagtaaaaaaaaaaaaaaaaaaaaaaaaaaaa

SEQ ID NO: 3658 - DNA, 1551 bp, Homo sapiens
ggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattct

SEQ ID NO: 3659 - DNA, 3687 bp, Homo sapiens
gagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcagggcaaatacagcaagaggaaagggcgattcaaacggtcagatgggagcacgtcctcggataccacatccaacagctttgtccgccagggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtgccaaacagaagcagaagtcgacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccagggaccctaccttgcttccggggaccagccactggaacgggccaccggggagcacgccagcatgcacgagtacccaggggagctgggccagcccccaggcctttaccccagcagccacccaccaggccgggcaggcacgctacgggcactgtcccgccaagacacttttgatgccgacacccccggcagccgaaactctgcctacacggagctgggagactcatgtgtggacatggagactgacccctcagaggggccagggcttggagaccctgcagggggcggcacgcccccagcccgacagggatcctgggaggacgaggaagaagactatgaggaagagctgaccgacaaccggaaccggggccggaataaggcccgctactgcgctgagggtgggggtccagttttggggcgcaacaagaatgagctggagggctggggacgaggcgtctacattcgctgagaggcaggggccacacggcgggaggaagggctctgagcccaggggaggggagggagcgaggggctcacacctgacatgtattcgcctccagggggcgctgtctccctcctttcagatgcctttgctcaaagcttggggtttctttggtgttaccatcccagctcccgggaggcccttaagccccagctgtcggtttttacctgcctgttgtggatggatgggggatacccacctttctgaagtgtcccctttctcccatcttaaggggctctcctccctcaccctcctagagaaaaggtgcacttccttaactctttctactcggggccctaagtgacggtcctaagtgggatggctctccttctcccaagctgcagtactggggaagggctgggcgcttttcctggaaagggaggccacagattctttcccatgggggctctcttccccagaccccagatccaaggtccctcaccctgcctgccccttcctcccagcttcctggcagcatcgtctggtcggtgaaagccatagcatggacaccccatggggagcttgtcttggggagggttctgggtggaagctggcaggcatacagcaccctctaccctccgtggccatggcaacgtccagggcccagaaccctgaggagtgagcggccgagacgctgctccccaccccccacctccatgcctcagcctttgcctaccccaggaatgagcttggcctccaacatcccttgcctgctgccattagtagagggggcccctctgcatctgagccccccatccctgtgccacctgggtgtggagcccatggaacactctggtccgcctcattttaaaccaaaaaactgctccttcaccctcaccctgaggccccaggggagaggacccgtgggatggtgcccaggggttgccttgggacctcggatctcctctggggggcttggctgctgctgttgctgctctgtatttgcctctcgtgattctgtttgttacccatgttcacttcccccaggagaggccttggtaccccctctcccctggggcatccctttgccttggcatccctgtagcccagcaaccctgcccctccccagcatcccagctgggccagagagagccgagtgtgccaacaaggactggggcctgcccggctgcccgcctcagggatgggcacctcatgcctgtctcgccacctcctgtgccaatgtcccaccctccacctgggggtggggtgcagcttccacttactgattagaagacaccactgccctcccttcccccctccctgtctggtgtcctgtgcccccatctgtctgtctatatttgtctgtactcccctaggagaagtattttgccatatataaaaccactgtcctgtcctttgtggctgcctcccaagcctgcttctttgtcctcgccacatagtcgtcagcgtaggcacctgggagctgctgatatgcacggggagttgaaagggtgggtgcctgaagatgttgtgccctgagtcattgactcaaaagaaaagatgatcctttgattttggccctctgatgtattgtgcccaagccaggagctgcttgggcagtcccagctccacactggccctgagccccttcacttacctgtctctccacaagtagagccaaaggcaatgggaagctcaatgttgctcagtgggtgagatccagacccactggtgcaatgtcttaaatacacatgactgtttttc

SEQ ID NO: 3660 - DNA, 2438 bp, Homo sapiens
gcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccccagggtccccgacatcctgagctcagtgaggaggggctcgggagccccagaagccgaggggcccctgccctgcccatctccggctccctttagccccctgccagccccatcccccaggatctctgacatcctgaactctgtgagaaggggttcaggaaccccagaagccgagggccccctctcagcggggcccccgccctgcctgtctccggctctcctaggccccctgtcctccccgtcccccaggatctctgacatcctgaactctgtgaggaggggctcagggaccccagaagccgagggcccctcgccagtggggcccccgccctgcccatctccgactatccctggccccctgcccaccccatcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaa

SEQ ID NO: 3661 - DNA, 2066 bp, Homo sapiens
gcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaa

SEQ ID NO: 3662 - DNA, 1994 bp, Homo sapiens
gcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaa

SEQ ID NO: 3663 - DNA, 1991 bp, Homo sapiens
gcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaa

SEQ ID NO: 3664 - DNA, 1949 bp, Homo sapiens
gcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcagccaagagtttactcaacaagaaagcagatggagtcaagccccagacgaatagcaccaaaaacagtgcagccgccaccagccccaaagggacgcttcctcctgccgccctggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaa

SEQ ID NO: 3665 - DNA, 1916 bp, Homo sapiens
gcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaaggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaa

SEQ ID NO: 3666 - DNA, 1877 bp, Homo sapiens
gcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcagccaagagtttactcaacaagaaagcagatggagtcaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaa

SEQ ID NO: 3667 - DNA, 1787 bp, Homo sapiens
gcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaa

SEQ ID NO: 3668 - DNA, 4900 bp, Homo sapiens
agggccgggcttcgtgcggtggggctcgctcgcgcggcagcggtggccgaggcctcttggttctgcggcacgtgacggtcgggccgcctccgcctctctctttactgcggcgcggggcaagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggacagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctagtaaaaa

SEQ ID NO: 3669 - DNA, 4953 bp, Homo sapiens
agggccgggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggacagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctagtaaaaa

SEQ ID NO: 3670 - DNA, 1398 bp, Homo sapiens
agcggaggggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaataaaaaaaaaaaaaa

SEQ ID NO: 3671 - DNA, 2250 bp, Homo sapiens
tttttatgcgggattaagcttgctgctgcgtgacagcggagggctaggaaaaggcgcagtggggcccggagctgtcacccctgactcgacgcagcttccgttctcctggtgacgtcgcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaggacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtacttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttacggtatcagataccaatatttaaaagtttgtataataataaagagtatgattgtggttcaaggat

SEQ ID NO: 3672 - DNA, 2289 bp, Homo sapiens
tttttatgcgggattaagcttgctgctgcgtgacagcggagggctaggaaaaggcgcagtggggcccggagctgtcacccctgactcgacgcagcttccgttctcctggtgacgtcgcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagccgagggtgggctggcagtgtctgccttctatcctgcagactggcgagatagttgccctcaagaaggtggccctaaggcggttggaggacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtacttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttacggtatcagataccaatatttaaaagtttgtataataataaagagtatgattgtggttcaaggat

SEQ ID NO: 3673 - DNA, 1296 bp, Homo sapiens
caaaactcactgacatttcccatcagtggttaatcagtcaaaaacatatagaatgacagcaaaaattaaagataagcaagataatgaagaaatatgttttgcaatcctgttgaagacagaataagcaaaagtgaccaagagaaacagattcaccaagtctgttgattgatttaaagtggatttatgtttaagtagaaaaccactccaaaagcatactttagggaagatgtcagctccaagattactgatttccatcattatcatggtgtctgcttcaagtagttcatgcatgggtggaaagcagatgacacagaactattcaacaatttttgcagaaggtaacatttcacagcctgtactgatggatataaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgttgagagaataacctgggtctctagacctgatcagaattcggaccttcagattcttccggtggacaccactcatgacgggtattacagaggcatagtggtaacacctgatgggaatttccatcgtggatatcacctccaagtgttagttacacccgaagtgaacctatttcaaagcaggaatataactgcagtatgcaaggcagttacagggaagccagctgcccagatctcctggatcccagagggatctattcttgccactaagcaagaatactggggcaatggcacagtgacggttaagagtacatgcccctgggagggccacaagtctactgtgacctgccatgtctcccatttgactggcaacaagagtctgtccgtaaagttgaattcaggtctcagaacctcaggatctccagcgttgtccttactgatcattctttatgtgaaactctctctttttgtggtcattctggtcaccacaggatttgttttcttccagaggataaatcatgtcagaaaagttctttaaagaagaaggaagggtcttcttttgcttctcctccttgtctctggactgcaacattggtgagatgagtgatggtccagcagtgaacttgggccatggatgatgttaaggatagaagccactcagtaggatagaagaaaagaaagatggaagaaggatcctgggcttgatgaccatgaagtttccctataaaccctcaaccacctattcattgacttcttttgtgttagagtgaataaaattttgttcatgccagt

SEQ ID NO: 3674 - DNA, 985 bp, Homo sapiens
caaaccatgggaggctcctctcctagaccctgcatcctgaaagctgcgtacctgagagcctgcggtctggctgcagggacacacccaaggggaggagctgcaatcgtgtctggggccccagcccaggctggccggagctcctgtttcccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaagggtgcaacatagaaaatgcctgctacccgctgggcatctgtgctgaacggaccgctatccagaaggccgtctcagaagggtacaaggatttcagggcaattgctatcgccagtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaaaaaaaaaaaaaaaaaaaaaaaaaaa

SEQ ID NO: 3675 - DNA, 2196 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggatgaaagtggcttcaaagatccctccagcgactgggaaatgtcacagtcttcaataaagagttctatttgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggaacagagacccgccttaagagactggatcgcacacctttgcaacagatgtgttctgattctctgaacctacaaaatagttatacatagtggaataaagaaggtaaaccatc

SEQ ID NO: 3676 - DNA, 1462 bp, Homo sapiens
ggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgagaaaaaaaaaaaaaaaaaa

SEQ ID NO: 3677 - DNA, 3178 bp, Homo sapiens
gatctcttggagacggcgacccaggcatctggggagccacagaagtcgtactcccttaaaccctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggagggatctgtaggcctttctgtccagcgctctgtttttggagaaagaaatttcaatatacacagctccatttcacatgagagccctgcagtgaaactcatgaagcagtcaaagactgtggatgtactgtctagaaagttagcaacaaaaaagaaggctatttctacgaaagttatgaatagtgctgtgatgaggaaaactgccagttcttgcccagctagcctgacctgtgactgctatgcaacagataaagtttgtagtatttgcctttcaaggcgtcagcaggttgcccctagggcaggtacaccaggattcagagcaccagaggtcttgacaaagtgccccaatcaaactacagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttgggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctgcgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaaattgaatgctcttgaatttgtatattcaataaagttatccttttataaaaaaaaa

SEQ ID NO: 3678 - DNA, 1627 bp, Homo sapiens
attcctagtgactccaagcgcttaaaaggggcccgggaggatgaaccccacagatctgaacctgatttgtgtgtgcaccgcgtctccagcgatcccggatccactgcgctgccaggggcctgggggtgggtctcttgctgtctctgcgacgacatccttacgtttcggcactctaatgctgggtttgtgcgtgtgtgtctgcttagcggtctagcgggctgttaggctccctcgcccccagctccttggctcgctcagctcctccaccgcagcccagcagtgagacgcgcgcgcagccagctccccacgagatggaacagaccgaagtgctgaagccacggaccctggctgatctgatccgcatcctgcaccagctctttgccggcgatgaggtcaatgtagaggaggtgcaggccatcatggaagcctacgagagcgaccccaccgagtgggcaatgtacgccaagttcgaccagtacaggtatacccgaaatcttgtggatcaaggaaatggaaaatttaatctgatgattctctgttggggtgaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaagtggatttgaacacaaaaaaaaaaaaaaa

SEQ ID NO: 3679 - DNA, 2195 bp, Homo sapiens
tcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacgggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaaaccttcaagaagtccttgcaagagccattcaacactgaagtcaagggggaaaccttcaatatactagctttaaaatgcctttctcctccctgaatggagggctgagttactatttttatttacaatgaatccttccaaactaaaaaaaaaaaaaaaaaaa

SEQ ID NO: 3680 - DNA, 6511 bp, Homo sapiens
attttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaaggaaaaaaccaaaagcataaaaaaccacagcaaatttcttgatgaaaattgaaaataaaagtttccttgtattttaaaaaaaaaaaaaaa

SEQ ID NO: 3681 - DNA, 9646 bp, Homo sapiens
tcgcccgccgcgcgcgccggtccggcagcgcacgggttaaggctggcaccgcgcccggcgggagggggggcgcccacctcccctcctccccgcgccgggcatgcggggcccagtgggcaccgaggaggagctgccgcggctgttcgccgaggagatggagaatgaggacgagatgtcagaagaagaagatggtggtcttgaagccttcgatgactttttccctgtggagcccgtgagccttcctaagaagaagaaacccaagaagctcaaggaaaacaagtgtaaagggaagcggaagaagaaagaggggagcaatgatgagctatcagagaatgaagaggatctggaagagaagtcggagagtgaaggcagtgactactccccgaataaaaagaagaagaagaaactcaaggacaagaaggagaaaaaagccaagcgaaaaaagaaggatgaggatgaggatgataatgatgatggatgcttaaaggagcccaagtcctcggggcagctcatggccgagtggggcctggacgacgtggactacctgttctcggaggaggattaccacacgctgaccaactacaaggccttcagccagttcctcaggccactcattgccaagaagaacccgaagatccccatgtccaaaatgatgaccgtcctgggtgccaagtggcgggagttcagcgccaacaaccccttcaagggcagctccgcggcagcagcggcggcggcggtggctgcggctgtagagacggtcaccatctcccctccgctagccgtcagccccccgcaggtgccccagcctgtgcctatccgcaaggccaagaccaaggagggcaaagggcctggagtgaggaagaagatcaaaggctccaaagatgggaagaaaaagggcaaagggaaaaagacggccgggctcaagttccgcttcggggggatcagcaacaagaggaagaaaggctcctcgagtgaagaagatgagagggaggagtcggacttcgacagcgccagcatccacagtgcctccgtgcgctccgaatgctctgcagccctgggcaagaagagcaagaggaggcgcaagaagaagaggattgatgatggtgacggctatgagacagaccaccaggattactgtgaggtgtgccagcagggtggggagatcatcctgtgcgacacctgcccgagggcctaccatctcgtatgcctggacccagagctggagaaggctcccgagggcaagtggagctgcccccactgtgagaaggaggggatccagtgggagccgaaggacgacgacgatgaagaggaggagggcggctgcgaggaggaggaggacgaccacatggagttctgccgcgtgtgcaaggacgggggcgagctgctctgctgcgacgcctgcccctcctcctaccacctgcattgcctcaacccgccgctgcccgagatcccaaacggtgaatggctctgcccgcgctgtacttgccccccactgaagggcaaagtccagcggattctacactggaggtggacggagccccctgcccccttcatggtggggctgccggggcctgacgtggagcccagcctccctccacctaagcccctggagggcatccctgagagagagttctttgtcaagtgggcagggctgtcctactggcattgctcctgggtgaaggagctacagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccattgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagtcgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagggcgctttcggctcctcccagatgtacagcaacaactttgggcccaacttccggggccctggaccgggagggattgtcaactacaaccagatgcccctggggccctatgtgaccgatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcgaacctgcagcactgatgtctctttaccgatgggttccagacccaaggtagtcctggcactgccctgtggactcagcccagctggggaggacatggcgcccggtgccctaggagccctcagtgtcccctacctgacctgtctgcacctgtgtgacagccccttctgatttggccccctgcccgcttggagcctcccagcaccagacagggcaggtttggggagccgctgtcgagccctatggtgagaccctggctgacatttcccctccttcctgccaaggctggaggccgccaggtgtttgctctctccttgtggggaggtggatcctctgccagcaggtgtctgtccccggcccagcgcatcttgaaggccctggactctgttaccagtggggggcctgtggccccggctcttcacagcaggcagaagcgtatgatcccagggagggtgggctgggggggggccagcacttgcctcggagccactgctgcgttgggtttgccttctgccagaggtgtggttaagggcagtgatagctgcgccccagcaaggagggtcatgggccctgagctggcccaggagaccctggccctgccctgtgccctgggatgcctaccctgcccacctccggaggtggaaccgggctgcccctgggggcctggacttgtcccattcccctgtccctggaaaggccttcccgggggctttttgcctgaggctgcactcttggaaggtgtggggagagttctgcctggagggggactggacccagtgccctctgcagacccctcccagccgcagcaccaagggcttgctgccttgtttcctgccaggagcgccctgacatcccaaaaccatcttcccacatgtgggttgttggaatcccacccactcccccggaccctgcccctccaagttggggacggagatggggagcaggtcaggccctccctaggcctgtttgtgtgtgatccttctcctggccccaggtcgacctggaaggcgtttctgagtcttgtactgggaccttcccagggaaggtgccttggggtgcagaatcctgggaatgttaggaaagggctgcgtgaaaaacccagctgggcctggggtggaggtgcacacgggctggggctcagctccttggagagggcctgcctgggactgagggggccagggctgggtcaggattcaccagcttgtgttgcagacactggagcaattgcctggccctccctaagccctatatgcctcactcataatgaggctgtctctgaaccccggagggcgggacctacaagtccttcctcttggcgcattcccacactccagtctggatccaggtctgcaaggccagcccgaccctgacactgcacgtgggcgtagtggggagcaccctggagtggagatgattgtcagcgggctcacatgttatggttcatccacatgcgtgttgtgtgctctgcggtgcctcctggcaaagggtcctggctcgggtcagaagctcactcccgtgccctcgtccccaaacaagcagtggcaagcactggggttggccctcgttgggagcagtgcccaccttccttggcccacagcagataggtcccgagcagcaggactggaggcctgtggcggtcagggcaggggtctgtgtctccaccccaagggctgatggtccctcccctgtgcgccttcctctcaggcaggcttgctctgtcccttcctctctgcttccctcccaggcctcgccagggctcccttctcctctgcctggttagactcgggcacccaggaaagcctggccagggctcctttgggcctgggccccctgcactgcctggtccagaaggggtggtgctgtccgtggccagcaccccggggcccgggaggggtgggctactagagtcagagcgggtttggggctgaccagtttgggagaggagaaaagatctgagaatgtccttcttggtttgtcagtcatctctgccaaaagtggtgatggtggtgtccgtatgtttggcgtctttgggctgggtttggtttttgctgctggtagaatcagggtcctcgggcatgaacgcgagcccaaagtgccagtctgcgattggaaatttccagccactttaagccagtgctgagtagggcttctgcagagccatgtttgagccaaggtcttggaaggcattgccccatgggctcaggtgactcggggtggagtgagcacgtctgcagggccctctcatacacgcctgaggcagaagcagcgtcccccgtgaaagccaccttccgaagctcctgcgttttttgcaaacttggcttcccccaggggcaggctggactttccctgccccctatgattgaagtcctcctgcttttgggggctgccttcccagagtcccccgggtgctcccctgccgaggtcaggagctgaccaagccttggcccggtgacacctgcagccctcactcctgtcatcccaggacacttgaggcccaaggaggtggagtggagagtgggctcgggtacatgggagccagaagccagatggacttggtcaagtgttggtcacttggagcctccagtgtgcgtcagggtctgtgggcaggggacagggcgtgggtgggggccgaggctggcacgcccctctgccctcaccgtcttggtgacctggcctcggcccctcccccaagtctcttctgtgcaaggcccgcctcggcctcggcagctggttcctgtcccgttttctgtgtctgaaagtttacaggttgtggtgcatcagcccaaactcactggcgttgtgttttttttttctttaattttcagattttttttttaaacaaagtatttttttaggtgcgataacccagaaagggcccgttgggtgtgtgtgtgtgtcctgaactcctcaagcagcgattggagcccaagcacccctggagaggaagggagggtccccactggcccgtggggtctgagttcaggggtgtggagggagcagactccaccggcccaggcccagctaagagggggccgacccctttccccaggcacagccccaggctggcaaagggagggccctgggctgggtgcagggcgcgccaggagtcccagccagggtggccccggcgggggcgggtccagctttggaagccaggctcccctgtgagccgtggcttgtctggtcttcgcccacgggaggctggacagaggctgtagccaacacaatcacctttactttgtactctgtgtgtatgttttggttttctgtgttttaataaatcctttgggaaagg

SEQ ID NO: 3682 - DNA, 2468 bp, Homo sapiens
ccacgcgtccgggcgggagctgtggcgcggagcggcccctctgctgcgtctgccctcgttttgtctcacgactcacactcagtgctccattccccaagagttcgcgttccccgcgcggcggtcgagaggcggctgcccgcggtcccgcgcgggcgcggggcgatggcggcgcgggggtcagggccccgcgcgctccgcctgctgctcttggtccagctggtcgcggggcgctgcggtctagcgggcgcggcgggcggcgcgcagagaggattatctgaaccttcttctattgcaaaacatgaagatagtttgcttaaggatttatttcaagactacgaaagatgggttcgtcctgtggaacacctgaatgacaaaataaaaataaaatttggacttgcaatatctcaattggtggatgtggatgagaaaaatcagttaatgacaacaaacgtctggttgaaacaggaatggatagatgtaaaattaagatggaaccctgatgactatggtggaataaaagttatacgtgttccttcagactctgtctggacaccagacatcgttttgtttgataatgcagatggacgttttgaagggaccagtacgaaaacagtcatcaggtacaatggcactgtcacctggactccaccggcaaactacaaaagttcctgtaccatagatgtcacgtttttcccatttgaccttcagaactgttccatgaaatttggttcttggacttatgatggatcacaggttgatataattctagaggaccaagatgtagacaagagagatttttttgataatggagaatgggagattgtgagtgcaacagggagcaaaggaaacagaaccgacagctgttgctggtatccgtatgtcacttactcatttgtaatcaagcgcctgcctctcttttataccttgttccttataataccctgtattgggctctcatttttaactgtacttgtcttctatcttccttcaaatgaaggtgaaaagatttgtctctgcacttcagtacttgtgtctttgactgtcttccttctggttattgaagagatcataccatcatcttcaaaagtcatacctctaattggagagtatctggtatttaccatgatttttgtgacactgtcaattatggtaaccgtcttcgctatcaacattcatcatcgttcttcctcaacacataatgccatggcgcctttggtccgcaagatatttcttcacacgcttcccaaactgctttgcatgagaagtcatgtagacaggtacttcactcagaaagaggaaactgagagtggtagtggaccaaaatcttctagaaacacattggaagctgcgctcgattctattcgctacattacaagacacatcatgaaggaaaatgatgtccgtgaggttgttgaagattggaaattcatagcccaggttcttgatcggatgtttctgtggacttttcttttcgtttcaattgttggatctcttgggctttttgttcctgttatttataaatgggcaaatatattaataccagttcatattggaaatgcaaataagtgaagcctcccaagggactgaagtatacatttagttaacacacatatatctgatggcacctataaaattatgaaaatgtaagttatgtgttaaatttagtgcaagctttaacagactaagttgctaacctcaatttatgttaacagatgatccatttgaacagttggctgtatgactgaagtaataactgatgagatacatttgatcttgtaaaaatagcaaaatattatctgaactggactagtgaaaaatctagtatttgtatcctggcaaataatactaatttataatccacagtaaagttcatcctttgactgtgctggagaattccagttgtatttgaagactgattttaaaacttttctgcatttggtaaaggtatgtaaactttcctgtactcactgagtaacagctaatctttaatataatattatactgctatatttaaaaagctgactacttgatataattacttaatgtgatgcttgatataataattacttaatgtggccgggcacggtggctcacacctgtaatcccagcactttgggaggtcgaggtgggcgtatcacctgaggttgggagttcgagaccagcctgaccaacgtggagaaaccccgtctctactaaaaatatgaaattagccagggtggtggtgcacacctgtaatcccagctacctgggaggctgcggcaggagaatcgcttgaacccaggtggcggaggttgcggtgagctgagatcacgccattgcactccagcctgggcaacaagagcaaaactcagtctcaaataataataataacaacaacttaatgtgctgctgcttttccataaccaacattttaaaaataaatgaaaaacaggaaaaaaaaaaaaaaaaaaaaaaaaaaaaaaaaaaaa

SEQ ID NO: 3683 - DNA, 2170 bp, Homo sapiens
ggctcgagagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgaaagctcccagtgaggaactggtcttctggagactctgtgtggcatagagtgattcaaccaccttaagaagacctctggctttcctggaacacagatgtcgagacatctcccatggatttgtgatcagcgttgcagctctcccagcagccctggacggtggcccccagccgcccgcatgtggctgccacggttctccagcaagacagtgacagtgctcctcctggcacagaccacctgcctcctgctcttcatcatctcccggccagggccctcatccccagccggcggcgaggatcgtgtgcacgtgctggtgctgtcctcgtggcgctcgggctcatccttcttgggccagctcttcagccagcaccccgacgtcttctacctgatggagcccgcgtggcatgtgtggaccaccctgtcgcagggcagcgcggcaacgctgcacatggccgtgcgcgacctgatgcgctctatctttttgtgcgacatggacgtgtttgatgcctacatgccacagagccgaaacctgtccgcctttttcaactgggcaacgagccgcgcgctgtgctcgccgcccgcctgcagcgcctttccccgaggcaccatcagcaagcaggacgtatgcaagacactgtgcacgcggcagccattcagcctggcccgggaggcctgccgctcctacagccacgtggtgctcaaggaggtgcgcttcttcaacctgcaggtgctctacccgctgctcagcgaccccgcgctcaacctgcgcatcgtgcacctggtgcgcgacccgcgggccgtgctgcgctcccgggaggcggcgggcccgatactggcacgcgacaacggcatcgtgctgggcaccaacggcaagtgggtggaggccgaccctcacctgcgcctgattcgcgaggtgtgccgcagccacgtgcgcatcgccgaggccgccacactcaagccgccacccttcctgcgcggccgctaccgcctggtgcgcttcgaggacctggcgcgggagccgctggcagagatccgcgcactctacgccttcaccggcctgaccctcacgccacagctcgaggcctggatccacaacatcacccacgggtcggggatcggcaagccaatcgaggccttccatacttcgtctaggaatgcgcgcaacgtctcccaggcctggcgccacgcgttgcccttcactaagatcctgcgcgtgcaggaggtgtgcgccggcgcgctgcagctgctgggctaccggcctgtgtactctgcggaccagcagcgtgacctcaccctggatctggtgctgccacgaggcccagaccacttcagctgggcatcgcctgactgagaactctgggccttagagcaagccccgaactgtggtcgccaggcccaggaggcgactgcatggtggagagggagctggggcgcatggggaagcaggtccctactatcaaccgggagtttggggtcctcccctgaagtaggcaaggactgcacgtttctttctctcctgattctcggttttcctttgagtcttctggagctgccttctcatcaggtgcactcttcatggaaagcaactcttgcccctacctcttctgggcgcagggagtaagttactgctaaattaaattaaatgtgtgccaggccgggtgcggtggctcatgcctgtaatcccagcattttgagaggctgaggcgggtggatcacctgaggtcaggattcaaaaccagcctggccaacatagtgaaaccccctctctactaaaaatgcaaaaattagtccggcgtggtggcacactcctgtaatcccagctacttaggaggctgaggtgggagaatcacttggactccaaaggtggaggttgcagtaagctgaaatcatgccactgcaccctagcttgggtggcaaagcaaaactctatcaaaaaaataattaataaatttgttcaaaagtcctgccgaaaaaaaaaaaaaaaaaaaaaaaaaaaaaaaaaaaa

SEQ ID NO: 3684 - DNA, 3278 bp, Homo sapiens
ctctggctgctgctccaactctggcagacacgccaagctttgagaaagctcccagtgaggaactggtcttctggagactctgtgtggcatagagtgattcaaccaccttaagaagacctctggctttcctggaacacagatgtcgagacatctcccatggatttgtgatcagcgttgcagctctcccagcagccctggacggcggtgagtcccctcagctggccaggacagtactctgctctcacctctctgcttcttgggctccatcccaactccccatcaactgatcttcttgcaaacccacagggctccaggacaccctccttctggagcccatgctgcctacagcacttcactccccaccagtgatgacaacaattgctgttctttgtccaccttatttacttgtttatctttaatgacaaaagttttttttttgttgttttttttttttttttgaaacgggagtctcactcttcactcaggctgcagtgcagtggcgcaatctcagctcactgccacctctgcctcccaggttcacgccattctcctgcctcagcctcccgagtagctgggactacaggcgcccaccatcacgcctggctaattttttgtatttttagtagagatggggtctcactgtgttagccaggatggtctcgatctcctgacctcgtgatccgcccgcctcggcctcccataatgctgggattacaggcgtgagcaaccgcgcctggctgacaaaagttttatacctgcctgttaaaaaaattatataatacagaagcacaccttgtaaaaggtgcaatcctcagttatgggcatgactgcgtgttcccttcccccatcttcattataataaccccccaatccccccagatcctgtgagccaggtaccggaattatccctctttcacacacgggtaaagtgatccgtcacagagagatttaagtgatcttcataagcaagatcataggctaggaagtggcagagccaggattcaacctcggcgagcctggtggtgctctgacatccaccgaagcccccatcaagcccttttagctccacaacctaaaagggtctctctaagaggtatcctgaagcaaaagacaggagttctctttgaaacatagtatttctctctacagatagatagcctgtaggtatgtaagtaggtgggtgggtgggtaggtagacagtttgatgatatcccacattattctgcaactggacttctgctgtgagcacagactatattctggcctatgtcttgactccgtattcctgggaaagtgctcgactgagaccttgggagtcttgggaagtccaatgggtagggtagccggaatctgagggctgatccctgagggcactgggcagtaattggggcatgggatgggcatgagggcccgggtccctaaagttgcccactccacccgaaggcccccagccgcccgcatgtggctgccacggttctccagcaagacagtgacagtgctcctcctggcacagaccacctgcctcctgctcttcatcatctcccggccagggccctcatccccagccggcggcgaggatcgtgtgcacgtgctggtgctgtcctcgtggcgctcgggctcatccttcttgggccagctcttcagccagcaccccgacgtcttctacctgatggagcccgcgtggcatgtgtggaccaccctgtcgcagggcagcgcggcaacgctgcacatggccgtgcgcgacctgatgcgctctatctttttgtgcgacatggacgtgtttgatgcctacatgccacagagccgaaacctgtccgcctttttcaactgggcaacgagccgcgcgctgtgctcgccgcccgcctgcagcgcctttccccgaggcaccatcagcaagcaggacgtatgcaagacactgtgcacgcggcagccattcagcctggcccgggaggcctgccgctcctacagccacgtggtgctcaaggaggtgcgcttcttcaacctgcaggtgctctacccgctgctcagcgaccccgcgctcaacctgcgcatcgtgcacctggtgcgcgacccgcgggccgtgctgcgctcccgggaggcggcgggcccgatactggcacgcgacaacggcatcgtgctgggcaccaacggcaagtgggtggaggccgaccctcacctgcgcctgattcgcgaggtgtgccgcagccacgtgcgcatcgccgaggccgccacactcaagccgccacccttcctgcgcggccgctaccgcctggtgcgcttcgaggacctggcgcgggagccgctggcagagatccgcgcactctacgccttcaccggcctgaccctcacgccacagctcgaggcctggatccacaacatcacccacgggtcggggatcggcaagccaatcgaggccttccatacttcgtctaggaatgcgcgcaacgtctcccaggcctggcgccacgcgttgcccttcactaagatcctgcgcgtgcaggaggtgtgcgccggcgcgctgcagctgctgggctaccggcctgtgtactctgcggaccagcagcgtgacctcaccctggatctggtgctgccacgaggcccagaccacttcagctgggcatcgcctgactgagaactctgggccttagagcaggccccgaactgtggtcgccaggcccaggaggcgactgcatggtggagagggagctggggcgcatggggaagcaggtccctactatcaaccgggagtttggggtcctcccctgaagtaggcaaggactgcacgtttctttctctcctgattctcggttttcctttgagtcttctggagctgccttctcatcaggtgcactcttcatggaaagcaactcttgcccctacctcttctgggcgcagggagtaagttactgctaaattaaattaaatgtgtgccaggccgggtgcggtggctcatgcctgtaatcccagcattttgagaggctgaggcgggtggatcacctgaggtcaggagttcgaaaccagcctggccaacatagtgaaaccccctctctactaaaaatgcaaaaattagtccggcgtggtggcacactcctgtaatcccagctacttaggaggctgaggtgggagaatcacttggactccagaggtggaggttgcagtaagctgagatcatgccactgcaccctagcttgggtggcagagcaagactctatcaaaaaaataagtaataaatttgttcaaaagtccgaaaaaaaaaaaaaaaaaaaaaaaaaaaaaaa

SEQ ID NO: 3685 - DNA, 3539 bp, Homo sapiens
ccggaaccggccttggaacaactgtggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttagtagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccggtcccttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattaaaaaaaaaaaaaaaa

SEQ ID NO: 3686 - DNA, 4817 bp, Homo sapiens
gtttgaggccggccagtcgtgactgggcggcaatgaggtcagtgactgccgggagtcctgcaggggcggggcggcgccaagcgcagggagcccggctgagtggcagcccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggatgctcttaaaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagcttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgtaatcccagctatttgggaggccaaggcaggagaattgcctgaacccgggaggcggaggttgcagtgagctgagatcgcaccactgcactccagcactccagcctgggtgacagagcaagactctctctcaaaaaaaaaaaaaaaaaaaaattctagaccgaagtgtacggcagtgccatctggtggcaagtggtacaaagacaacgctgaggggtagtgactcctgtagcagcagagacgccttggagtttaacccccaccaaccagagcgtgggctggtaaagatgaaatcttgcaagttttttttttttttaaatcatggtacctgttttaaaatgagaagttattattcatactgtgttgctcatttgacaaaataaggtaaggatttcataatcaggttgtctgggtttcagagctgtttttaattgactgagttacctacaggcacccaatctagaccctaattctgtggttggtgttcctctgtagatttcaagacaagtagtgatgtcattttctccctgagctgtagggtggacctggacccctcagagatgctcgactgcagggtcctggggtccctagagtggtcctgcagcagcccctggcaatgagctgcctgatgatgagtcccaaggtacattgttctactgttttatacccaggtagaagttacacagcaatttagcaatgttgttaacagacatacagaattgtgtgtgtgtgtgtgtgtgtgtgtgtgagtgttttgatataaacgtgcaattaaaattcaaagtttattttttatcacaagcacctttgaaatgtacgtggaaaacgtcggctgctcgtgagaatcatgtgtgacttacgttccttatgttttatggaactctcggaacagtgttttgtttttgtttagtttttgttttcgtttttttgagacggagcctggctttggctcccaggctggagtccagtggtgtgatctcggctcactgcaacctccacctcccgggttccagggattctcctgcctcaccctttcaagtagctgggattacaggtacctctaccatgcctggctgattttttgtatttttagtagagacagggtttcaccatgttggccaggctggtctctgactcctgactaaaagtgatctgcccacctcggcctcccaaagttctgggattacgggcgtgagccacttcacccggcccggagcggtgtattttgattgctggtgctttaactatattgaccaaggtgtatagtaacctatttatcacattttacgaagcaattttaatcttaaacacatccagcaaatggtgtccctgctgaaacttttaactggaaacctcacacctggcaggcagcactctctgcagccgtgcccttgtggagtcagcaggagctggtgtttttcagccagacagaggcataataaagtgactgatgtttacagaacccaaatgatgtcttcctctctctcaaaataaactaacctattcatattgctgtgaatgctttatcttggagatagaaaatataatgataaattcatcatgtgttcagaattcgatttggagttggaagtggacagcctaatttttatctcacctccactaggactttgaccttcccaggggtccacactttacctcctgtatcttcatacgcgtgtgtggatgcatagagatggaggtgctgtagagaagcacaggctcacccgctccgtccagtgtcacccacacattggtccggggacccctcagtgcagagcctgaagttgggggtttaggggtggaaaaggcttcgtgaaatgttaatgatgcgtacaccttccagatggcacagcactttcccatggtcctcactggcctcagtctccctgaccggcagtgtgaggggatgtagctatagtggagcatggtacaagcgacattcatgagctctgacttcttggtgccaggttggtgtgagcctgggcccggcccactcagcggcccacattggccagcattcagctgcacgtgtgtgctgcgtgcttcacatcctctattgagagttacagcaagtgttaaacgaggtgagttcacataacaggaattctggaactgcttgaaaactaggacgattgggcaatatcggccttaactccacctgatggcaggtgacccggatagaaaatggccctgcgtttagccaggatgtggctctccagcttggcttcagtgtgatcacttgtcagtgcgctttctctttcgatagtgaaatccttctctatacctatgttttgttttgtttcttaagttgggaaacagaatgggccagggaggttgagtgactgaagaccaagggttggtgcagcctcctcgccgcgctgcgggggctgggccgcacaggcttctgcccttctcggtgtccaggctccttgggtgatgctggagttgtcatggccgcagttcagtgtgagattttttaccaggtattgcgcttaagggacatgattttccattttcttcgcccggacaacttgaatgaaatgggcactgttgattccacttctgtcgaggagcttcggggctcagagaggtgatgacgtgcccaaggtgacgcaactcgtgaacagccgtgcctgccttgggcgcagcctccggcgccagagctgggctcttcaacacggcatttagcgcagaaagtcgtggttcaggcagtatgggccgctgtgacaaaacacctaagactgggtagtttataaagaacagacattcaggccaggcacggtgactcacgcctgtaatcccagcactttgggaggccgaggcgggtggatcatttgaggtcaggagtttgaaaccagcctggccaacatggtgaaaccccatctctactaaaaaaacaaaactagctgggggtggtggtgcatgcctgtggtcccagctacttgggaggctaaggtagaagaattgcttgaacctgggaggcagagattgcagtgagccgagatcacgccattgcactccagcctgggtgacacagtgagactccatctcaaaaa

SEQ ID NO: 3687 - DNA, 3784 bp, Homo sapiens
gtggtctcgcgggcgggtgacgtcatcgaggcgagagaggcggagccgtggacagtgggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctccagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggtacaagcctgggaggaaggaggaaggattctccgggtggaagctggattatggggagtggagtgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgcaaaaaaaaaaaaaaaaaaaa

SEQ ID NO: 3688 - DNA, 3657 bp, Homo sapiens
ggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctgaccctgggtagaacgggtgaagggatgggggagcgtgaggttccgccctctcttgagactggaaccaattggagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcaagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctccagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcagtagtctgtaaaaaaaaaaaaaaaaaaaaaa

SEQ ID NO: 3689 - DNA, 3442 bp, Homo sapiens
gtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccggtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaaagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactctataatttgatagttacagttttctttgtatcataagattgtaagtcccgataatttttttttttttggtctcagtaacagggaagtaagtaacatgttgacctgagctagtattactgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcggcaaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagaaaaaaaaaaaaaaaa

SEQ ID NO: 3690 - DNA, 1134 bp, Homo sapiens
gacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 3691 - DNA, 981 bp, Homo sapiens
gacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 3692 - DNA, 978 bp, Homo sapiens
gacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 3693 - DNA, 3031 bp, Homo sapiens
ctcagacctgtcagcccgccacactccagccagtcccttccgatcacctccagacaccacgctctcctttcggagcccgcccgccggaagtgacggcccggaactactcccacaggggggcggggaaggaagatggcggcgcccagcgtcccgtgaggagagaggacacagggatcccggggagcggccccagactcgtaaattatggccgcatctccgcacactctctcctcacgcctcctgacaggttgcgtaggaggctctgtctggtatcttgaaagaagaactatacaggactcccctcacaagttcttacatcttctcaggaatgtcaataagcagtggattacatttcagcactttagcttcctcaaacgcatgtatgtcacacagctgaacagaagccacaaccagcaagtaagacccaagccagaaccagtagcatctcctttccttgaaaaaacatcttcaggtcaagccaaagcagaaatatatgagatgagacctctctcaccgcccagcctatctttgtccagaaagccaaatgaaaaggaattgatagaactagagccagactcagtaattgaagactcaatagatgtagggaaagagacaaaagaggaaaagcggtggaaagagatgaagctgcaagtgtatgatttgccaggaattttggctcgactatccaaaatcaaactcacagctctggttgtaagtaccactgcagctggatttgcattggctccgggcccttttgactggccctgtttcctgcttacttctgttgggacaggccttgcatcctgtgctgccaactccatcaatcagttttttgaggtgccatttgactcaaacatgaataggacaaagaacagaccgctggttcgtggacagatcagcccattgctagctgtgtcctttgccacttgttgtgctgttccgggagttgccattctgaccttgggggtgaatccactcacaggagccctggggctcttcaacattttcctgtatacctgctgctacacaccactgaaaaggatcagcattgccaacacatgggtcggagctgtggttggggccatcccgcctgtcatgggctggacagcggccacgggcagcctcgatgctggcgcatttctcctgggaggaatcctctactcctggcagtttcctcatttcaacgccctgagctggggcctccgtgaagactactcccggggcggctactgcatgatgtcggtcacccacccgggcctgtgccggcgcgtggcgctgcgccactgcctggccctgctcgtgctgtccgcagcagcccctgtgctggacatcaccacatggaccttccccatcatggcccttcccatcaatgcgtacatctcctacctcggcttccgcttctacgtggacgcagaccgcaggagctcgcggagactgttcttctgcagcctgtggcacctgccgctgctgctgctgctcatgctcacctgcaagcggccgagcggaggcggggacgcagggccccctcccagctgagagcactgggacgcccaccgcccctttccctccgctgccaggcgagcatgttgtggtaattctggaacacaagaagagaaattgctgggtttagaacaagattataaacgaattcggtgctcagtgatcacttgacagttttttttttttttaaatattacccaaaatgctccccaaataagaaatgcatcagctcagtcagtgaatacaaaaaaggaattatttttccctttgagggtctttatacatctctcctccaaccccaccctctattctgtttcttcctcctcacatgggggtacacatacacagcttcctcttttggttccatccttaccaccacaccacacgcacactccacatgcccagcagagtggcacttggtggccagaaagtgtgagcctcatgatctgctgtctgtagttctgtgagctcaggtccctcaaaggcctcggagcacccccttcctggtgactgagccagggcctgcatttttggttttccccaccccacacattctcaaccatagtccttctaacaataccaatagctaggacccggctgctgtgcactgggactggggattccacatgtttgccttgggagtctcaagctggactgccagcccctgtcctcccttcacccccattgcgtatgagcatttcagaactccaaggagtcacaggcatctttatagttcacgttaacatatagacactgttggaagcagttccttctaaaagggtagccctggacttaataccagccggatacctctggcccccaccccattactgtacctctggagtcactactgtgggtcgccactcctctgctacacagcacggctttttcaaggctgtattgagaagggaagttaggaagaagggtgtgctgggctaaccagcccacagagctcacattcctgtcccttgggtgaaaaatacatgtccatcctgatatctcctgaattcagaaattagcctccacatgtgcaatggctttaagagccagaagcagggttctgggaattttgcaagttatcctgtggccaggtgtggtctcggttaccaaatacggttacctgcagctttttagtcctttgtgctcccacgggtctgcagagtcccatctgcccaaaggtcttgaagcttgacaggatgttttcattactcagtctcccagggcactgctggtccgtagggattcattggtcggggtgggagagttaaacaacatttaaacagagttctctcaaaaatgtctaaagggattgtaggtagataacatccaatcactgtttgcacttatctgaaatcttccctcttggctgcccccaggtatttactgtggagaacattgcataggaatgtctggaaaaagcctctacaacttgttacagccttcacatttgtacaattcattgattctcttttccttccacaataaaatggtatacaagaaaaaaaaaaaaaaaaaaaaaaaaaaaaaaaaa

SEQ ID NO: 3694 - DNA, 1941 bp, Homo sapiens
cttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatggtagacaacaccaagtttacgatggactgcgtagcgcctacgatccacgtgtacgagcaccatgagaacagatggcggtgcagagacccacaccatgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatctggtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggcttttgaactatctttttttaaaaaaaaaaaaaagcccacatcttatactccaatgagtgtgtttgtgagtttttatcctgtttgaattttgatgtcgtccaggcgtcctgggatcagggtagacacgtggagtgctggtgctgagctgtttgagaagctctgtgtgggtgtttctgtggtcaggtaggctgggctgtgaacagcactgctccacatggtgtcggctcacagagccaccgcaactctgcccagcgggagtgacaccactgatgccacagaagcctttatcgttaggggcaaaagcagacatctctggtagcaggagctcagtgtggtgctcttcagccacgcagaaagctcacgtgcctgcagggccaggaaagggaaatgatcgtttcttttgtattaggaaaaacaagacttagacttcccgagttgtgcagagtgacgtctgtactttttatacttagaacatttggtcaagttttgtaaccaaaccttagggaattgagagggaaactttatggtacgtttaccttttttcctttttatatgaattattttgtacaaagttcagagagcggtacctttcctactgtcttttctttgactccatggaggaatttgtaacgatcggtgtgacctgaaagggtttgtgatacagcggtcactattttctcttaacacataggaaaaaagttcagacatcgctacaataaatgtgctttatttgatccaaaaaaaaaaaaaaaaaaaaaaaaaaaaaaaaa

SEQ ID NO: 3695 - DNA, 2714 bp, Homo sapiens
agctcgccggctcaatactccgggggtctgggtggggggctcaaacgcagggctctgggacgcaggcactgctccaggtgatagtgcgggaacatggccttgcagctgggcaggctgagctcgggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacagggctggccgcggcgctggcggggttggtggggctggccaccgccgccttcgggcatgtgcagcgggcggagatgttgcctaagacctcggggacgcgggccacttcgctggggaggccggaggaggaggaggatgagctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacaggtagacgggggcgccaacttttctgtggaccggtgggagaggaaggaaggaggtggcggcatcagctgtgtacttcaagatgggtgtgttttcgaaaaggctggggtgagcatttctgttgttcatggaaatctttcagaggaagctgcaaaacaaatgagaagcagaggaaaagttctgaagactaaagatggtaaattgccattttgtgctatgggcgtgagctctgttatccaccccaagaatcctcatgctcctactatccatttcaactacagatactttgaagtagaagaagctgatggcaacaagcagtggtggtttggtggtggatgtgacctcactccaacatacttgaatcaagaagacgctgtccattttcacagaactctgaaggaggcttgtgaccagcatggtccagatctctaccccaaatttaaaaaatggtgtgatgattacttctttatagcccatcgtggagaacggcggggcattggtggtatcttttttgatgatcttgactctccgtccaaggaggaggtgtttcgctttgtacagagctgtgccagggctgtagttccttcttacattccccttgtgaaaaagcactgtgatgactcattcaccccccaggagaagctgtggcagcagctcagaagaggacggtatgtagaatttaatctgctgtatgatcggggcacaaagtttggcctcttcactccaggatccagaattgaaagtatcttgatgtctttacctctaactgcccgatgggagtacatgcattcaccctcagagaattccaaagaagctgaaattctggaagttctacgccatccaagggactgggtgcgttgatgcaggcagaatggctgtgcaggggtttggagggcacacgatgtgtgctccccatgccactggtcggcactttgccactgtgtggcagttacccgtgccttagtcttctccactctgcaccctacctcgtgggcagatgataacatgttttggatgctgtcagtgatgaatggtgagatggcagattgtcagagtcaattgattaaacctcatttatacttctagtgtcattttatatgactagtttacaaaataggacattgagtttccaagtattgagataagggaatataaatagtattatatgtatcaggaaatctctcatcttgtttttgtttcatgtattttttaaagttttcatttgtgccacaaaaatctgtcgtggaatatattttattttcattaattcagtgaagttgagacttcatagtaattttagaatgcaacttgaaggtaaaaattttactttgtcaatactgaagtctctgctgtaatccttatatatctttctccagagaacataatattgtcaaatagatacacatttttctaataggtatttagaagcacttgaaataatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaacttggaggcatttcatacacacgtttcttaggaaaatggacacattgaaaatgtcctcttttttatattagagattctgcagctctttgctcttaagagcaaatcacaacaggattcttaatgtatgatttctttgttcatatattatgaatgtattattttatttgcttcgtaataaagtttataaggaagagcatctcatacatatcattatcgtggaacacgttgaatgtttgtgattctgtgtggcctttttggggctggaaaatgtatgaattcttcaactgtcttacaagagatctgctaataaattttattattaaataagactaaaaaaaaaaaaaaaaaaaaa

SEQ ID NO: 3696 - DNA, 7984 bp, Homo sapiens
cggcccggcggtaggcggtggcgactctgcccgctcccgtttcggcgcggtgaccgagcgcccgggaggctcgaggaccgcatcgtgtgccgttgcgccaagcccggtcctgcgccgccatggccccagtgcagctggagaaccaccagctggtcccgcccggaggcggcggcgggggcagcggcggacccccgtcagccccagcccctcctcccccgggagccgccgtggcggcggccgctgcagctgcggctagcccgggctaccggctgagcaccctcattgaatttctgctgcaccgggcctactcggagcttatggtgttgacggacctactgccaaggaaatctgatgtggaaaggaaaatagaaatagtgcagtttgctagccggacacgccaactcttcgttcgattattagctttagtgaaatgggctaataatgctggcaaagtggaaaaatgtgcgatgatttcaagctttttagatcagcaagccatcctgtttgtggacactgctgatcgcctggcctcgttagctagagatgctctggtccatgcacgcctgcctagttttgccatcccatatgccattgatgtactaactactggatcttacccacggctgccaacctgcattagggataaaattattcctccagacccaattaccaaaattgaaaaacaagccacactccatcagctgaatcagattcttagacatcggcttgtaaccacagatcttcctcctcagttagcaaatcttacagttgcaaatggccgggtgaagtttcgtgttgaaggagaatttgaagccaccttgactgtgatgggagatgaccctgatgttccatggcgtcttctcaagctagaaattctagttgaggataaggaaacaggagatgggcgagctttggttcatagcatgcaaatcagcttcatccatcaactggtgcagtctaggctctttgctgatgagaaacctcttcaggatatgtacaactgcctacattctttctgtttatcacttcagttagaagtgttacattcccaaactctaatgttaatccgagaacggtggggagaccttgtgcaggtggaaaggtatcatgctggaaagtgcctctccctttcagtttggaatcaacaggttcttgggagaaaaactggaacagcatctgttcacaaagttacaattaaaattgatgagaatgatgtctccaagcctttacagatttttcacgatcctcctttgccagcttctgattccaaattagtagaaagagccatgaagatcgaccacttatcaatagaaaaactcctgattgacagtgtccatgcaagagctcatcagaagctccaagaactgaaggccattcttagaggcttcaatgccaatgaaaactcttccatagagactgcactcccagctcttgttgttcccatcttggagccctgtggtaattcagagtgtctgcacatttttgtagatttacattctggaatgtttcaattgatgctttatggacttgaccaggccactctggatgacatggagaagtctgtgaatgatgatatgaaacgaatcataccctggattcagcaacttaagttttggcttggacaacagcgttgcaagcagtctataaaacatctgcctacgataagcagtgaaacattgcagctttccaattactcaactcatcctattggaaacctttctaagaataaactgttcattaaacttacccgccttccacaatactacattgttgtggagatgttggaggttcccaataaacccacacaactgtcgtacaagtactactttatgtctgtgaatgctgcagatcgtgaagacagccctgcaatggcattgctgctgcagcagttcaaggaaaacattcaggacttggtttttcgtacaaaaaccgggaaacagaccagaaccaatgccaagcgcaagttgtctgatgatccatgtccagtagaatccaagaaaacaaaacgagcaggagaaatgtgtgccttcaataaagttttagcccacttcgtcgctatgtgtgatacaaatatgccatttgtaggacttcggttggagttgtccaatctggagattccacatcaaggagtgcaagtggaaggtgatggcttcagccatgcaattcgcttattaaaaattcctccctgtaagggtataactgaggaaacccaaaaggctctggaccgctctcttcttgattgcactttccgattacaaggtagaaataaccgcacttgggtagcagagttagtgtttgcaaattgtccacttaatggcacttctactagggagcaaggaccatcccggcacgtttacctgacatatgaaaatctgttgtctgagcctgttggtggtagaaaggtggttgaaatgtttcttaatgactggaatagcattgcacgattatatgagtgtgtgttggaatttgcacgttctctaccagacatacctgctcatctaaatattttctcagaagttcgtgtttataattaccgaaaacttatcttgtgttatggaaccaccaagggaagctcaattagtatccaatggaattcgatccatcaaaaattccacatttctttgggaactgttggcccaaactcaggttgcagtaactgtcacaataccattctccatcagcttcaagaaatgttcaacaaaacaccaaatgtggttcagttattacaggtactgtttgatactcaggctccattaaatgccatcaacaaactccccactgtgccgatgttgggcttgacccagagaaccaatactgcctaccagtgcttctccattctgccacagtcgtccacccacatcagactggccttcaggaacatgtattgcattgatatatactgccggagtcgaggtgttgtggcaatacgggatggtgcctatagtctttttgataacagcaaactagttgaaggtttctatcctgcaccaggactaaagacgttcctgaatatgtttgttgacagcaatcaggatgctcgaagaaggtctgtaaatgaggacgataatcccccttctcctataggaggagatatgatggattctttaatatcgcagctccagccaccaccccagcaacagccatttccaaagcagccaggaacatcaggtgcttatcctcttacttcaccccctacatcttatcatagcacagtcaatcagtctccctcaatgatgcacacacagtctccaggaaatctgcatgctgccagctcccccagtggggctttgagagccccatcaccagcgtcatttgttccaactcctcccccatcctcgcatggaatctcaataggaccaggggccagttttgctagtccacatggaactcttgaccctagttccccatacactatggtgtcaccaagtggacgagcagggaactggccaggatctcctcaagtgtctggcccctcaccagcagcacgcatgcctggaatgtcaccagccaacccctcactacattctccggttccagatgcttctcattcccctcgagctggaacaagttctcaaacaatgccaacaaacatgcctccacctcgtaaactacctcagcgctcttgggcggcatccatacctaccatcctcactcacagtgccttgaacattttactgctgccctctccaactccaggccttgtgcccggcctggcaggtagttacctttgttctccacttgagagattccttggatcagtcatcatgagacgacatcttcaaagaattattcaacaagaaacgctgcagctgataaattctaatgaacccggagtgatcatgtttaagactgatgcactgaaatgcagagtagctcttagtcccaaaaccaaccaaacgcttcagctaaaagtgacacctgaaaatgcaggacagtggaaacctgatgaacttcaagttttggagaaattctttgaaacaagagttgcaggaccaccatttaaagctaatacgttaatagccttcaccaagctattaggagctcctacacacatcctcagggattgtgtgcacattatgaagctggagctgttccctgaccaagcaacacagctaaaatggaatgttcagttttgcctgacgatccctcccagcgcgccgccgattgcacctcctgggacgcctgctgtggtgctgaaatccaaaatgctattttttcttcaactaactcagaaaacatcggtccctccccaagaacctgttagtattatagttccaatcatttatgacatggcttcaggtacaacccagcaggcagacattcccagacagcagaactcttctgttgctgctcccatgatggtcagcaacattctgaagaggtttgcagagatgaatccaccacgacaaggtgaatgcacaatatttgcagctgttcgtgatttaatggctaatcttacactgccccctggtgggcgtccatagacactattgtttttaaaccaggaaggctgacagatgagacaacaaaaaaaatctgaattcagccttcagtttaaaaaaggaaaaggactttttttttaaactttaagagctaaatattctaaactggcaaaaattttcagggtgcacttctttcatcaaaatgatcatccatcttttgtataatgaacttgtatagtgtgtttaaatgggacacatttcaaaggaaataaatcagtgtccgtttgccagtaataaatttaatattctgttttatactataaagttatgaaaatgccaaacttgtttatttaattgttttcttatgttttgggtgtaatagtccttttttggtttttgttttgttttttaaggcaggtctgtcatttttgaatactgtaaaactgtgataaactttatattgaagctgtattttaatatgaccgctttgaatccttacatgaaatgttctgggagttgttataaacacaccccaaggaagcaatatttaataaaactaggtcaaaaacaaaacaaaacagtgacactcacttgtgtgtatataaactctagagacatcttaggccctcccttcatctttaacctggtggatggagccagttattaatttataataatacatgtctgaaatttgaccaaaaacatcttctttatgtcaaggttaatatattttcttcagacattcctaacttgactagtggttaacatttagcaccttggttgtctttcaatatataggatttgggtgaaaaataaggaacttagtctttgagaagggacagtatgtggttcgtattgatcaaggatcccaaataatgcaatcattctcatctgttgaggatgtgggaacttttctgtcaggaaaatttagtttacagaatacttctgcatacaacattaattaggaaacaaagaactttaatgctgtacctctgcatgaagtttctgtgagctttctttatcttgcttaacttatcctcctttccttccccaccaaaattgggattgttctaaacaatttcaatttaattcattgtcaacaaaacgatagaatgttttgcttggaagaaacctggtccattcccctcattgtgaagaatcccgaatcctgggcctgtccagggtcaaatggagtttttggtattaatacatctctgcagggtttctttttggagcactgtgctgtctttcctagtcagtcagggacttttttaagcttcaaagaacatggtctgatgcaaaggtcttctaccgacttcatggtatttaggaaaaatttttaagtgataataccatgccgagttacctggtcactgtaatactggttctccattaaaatgtagatgctttgtctaattccacttcaagatgatttaattgagcttctataactatcaactatcaaattctagtttcaagtatctcactgtacctatatcatatctgttctcaactttgtttgattctccactcattttcaatcagagttgaagccttctttgcctttcttctttgtcttatttctgccttcatctcccacttctcacccaactctgccactgttcaggagcagttgactaaacttttatccttcctttaacttaatctttttatccttctgtttttagttcttacagtggtaatcacatcagtttggcaatctaagatgtctttatcaagggtcagcccttttctatttggagctgaatcttttctttcatgtagaaatctacatgtatatacaagaaatgtatttttatctgcaggataatattgtttcaaataattttattaagagttaactttttaggtattttcccttttaatgtggttttgaaatgttaattgcatttttacacatgatgcattcagtggacactcttttttcctaattataactcatctctgaatgcattgtgccaatcaagagtaagataggattcagtgcgcaaaatttgcttttgatgcttattaagagtaaacccatgaatttgaatttttatattatgcttggtacttggaattgatatataccttattaaagcttgaaaacatttagcatttgaatagtaagtttcatcacaaatcatgtcttttgcctcttttgttacccaggttcgatcaaggggactggatgcccaagtgattttctctaataatcgggttgggacttaactttaaggtgttttcaatgtgattttagtatttacagtaataaataaaatttatacaaagtttcagagaactaccaactctctagttaattttgatgaagatgttttcattaatagtctggtttagtattaatttaaccttgaaataagaaattggtcctgatttgccaccttcatttttccatctgctgaaatgccatttcagaatgtataaaagtactttcagaattagaagaaaagtgagagcttcagcagaacgtgtcaagtcgctaataacaggagtcgaaccttatgtttgaaaattaactgagtgagttaagtgcaagcataaactaaaatttatatgactttgaatttaagaaccactaataactgtgttctaattaacacagtaatctgttcagccaaaggatactaacagccattctttggactgtggttaatttgataacttcaagaagttataactttgctaccctggattctgatgcaatttcaatataaaaagttgttcctttcatagtttttccccccaaaagaagtgcctattacattttaccttaatgtttatttatcatccaagtgttcttgatataaaatcagtatacagaaaattttaagagaacttacattcaagggacatagagggaaaatgttaatgtgtatttcattgtttcttgtggaatttttttttcattcggtttgagaatggacagtgtgtctaaggatgtgatttaaatttacttaggatggatttagcattgaggttattaagacaaagttagcagaggccagccagcactgtgctgcacaactccaggaactccatggtatgctcacaattttctgcaagttgcctccacttccaagtggccagtgatttgttaaaataccttgcccaagaatataactgattgatgaaagggcatatttaggtcaatataaaataatagcaagtatttactgagagcttactgtgtgctaggcattttcttaatatttcaatgtgtatttaatcctcacaacaacccaatgtggtaggttattgatatcctcttcttaaaaatgagtaaatggaggcccagagaaatgtaatttgcctgagatcaaattaaggttgcttaagatcaaactgctaagaaggggcagtttgagtctgagctagtgctcctaaacactggacatttttgctgtgaaccacagtcgggaaggtttaatgtttagactctttcctcagaggcttttaactacacacaattttgacatgttttccaagctcagaaagctcattaaaaacaactaaaactg

SEQ ID NO: 3697 - DNA, 1255 bp, Homo sapiens
cgctcgctcccgcaactggaggcacggcagaggaggcagggccgacggcggtgggcggtgcgttgcgcaggctcgggcctcccgctcgccgctgcgttgggaccgcgcagcccggtgtgtgcagtggcctcagggatccggaaagtctaggactgaacttctcctaacatccagtaatggggacctggaacctgggcgtactagagtgccgcgcgtagggctccaggtcgctggcttctgcgctttcttcctctccaaagttgagtatctcctatctgtgtcctcatacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacatgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaaaaaaaaaaaaaaaaaaaaaaaaaaaaaaaaaaaaaaaaaaaaaaaaaaaaaaaaaaaaaaaaaaa

SEQ ID NO: 3698 - DNA, 1667 bp, Homo sapiens
ctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagttttcaaattgtttgaggtcaggatttctcaaactgattcctttctttgcatatgagtatttgaaaataaatattttcccagaatataaataaatcatcacatgattatttt

SEQ ID NO: 3699 - DNA, 1876 bp, Homo sapiens
gagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctataaaaaaaaaaaaaaaaaaaa

SEQ ID NO: 3700 - DNA, 2238 bp, Homo sapiens
gcttactccttccggtcaccatggcgaccaggcgccttggggtcggggagacgctgggggccctcaacgcggccctggggccaggcggtccggtgtggatcaaggagacgcgcacccgccacctgcgttcccgagactttctggcaccgcaccgcgcgctgcaggcgcgcttcgatgacggccaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcagaagttggttgacaaggctccactcagacagaagcacctcatctgtggccctgtgaaagtagctggtgcacctggcactctgatgactgcccctgagtactacgagttccggcatacccaggtgtgcaaggcctcagcactgaagcatggtggggatctggcacaagacccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagggtgagtggttgttgctcttcaacagtatcctcccctttccggatctgctgagccggacagcagtgctggactgcacagccccggggctccacattgctgtacgcacagagatgatatgcaagttcctggtacagctcagcatggatttcagctcctactacaaccgggtacacatcctgggggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgttacaaagttctgtcttgtcatggggagtcgggcatattcttggcagcactccactcaccttcagctcctgcaccgacatcaggaacccacggccaccacctcctcccctcaaggcatgctgagcatgggcacagacagcccatccctgctccatgctgtctgtgagcaggccccatgcccagcacgccagccaccgcaggatacctcagtcataccagttgtaaacctcaagcccctgacccccaagggcacaacggtggccaaactcagggctcacaggccagcagtccatgtcagccacatcaggcacatggaacacagtgctattcatgaaggtgggttcaccatgccccagacgccagaaggtcagccgttgatcaatggaggctgagaccatgatgcttgggcttaggatcttgaggcctgtcacatgggcagcatgtgcacaggggacagagtattcctctagcacacgcagctggggtaccagcc

SEQ ID NO: 3701 - DNA, 2242 bp, Homo sapiens
ttcctctccggccccacgggcgcgcttccctcctgacggattccgaagcccgccccaccaccgtcaccgcaccagtggcccaggcttcgtgggaccaacagggctaatcctgccccacggatctaatccggatcgggacccggtcccaggggaggcccccacctccccttctattgttctgtggcccaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcagaagttggttgacaaggctccactcagacagaagcacctcatctgtggccctgtgaaagtagctggtgcacctggcactctgatgactgcccctgagtactacgagttccggcatacccaggtgtgcaaggcctcagcactgaagcatggtggggatctggcacaagacccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagggtgagtggttgttgctcttcaacagtatcctcccctttccggatctgctgagccggacagcagtgctggactgcacagccccggggctccacattgctgtacgcacagagatgatatgcaagttcctggtacagctcagcatggatttcagctcctactacaaccgggtacacatcctgggggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgttacaaagttctgtcttgtcatggggagtcgggcatattcttggcagcactccactcaccttcagctcctgcaccgacatcaggaacccacggccaccacctcctcccctcaaggcatgctgagcatgggcacagacagcccatccctgctccatgctgtctgtgagcaggccccatgcccagcacgccagccaccgcaggatacctcagtcataccagttgtaaacctcaagcccctgacccccaagggcacaacggtggccaaactcagggctcacaggccagcagtccatgtcagccacatcaggcacatggaacacagtgctattcatgaaggtgggttcaccatgccccagacgccagaaggtcagccgttgatcaatggaggctgagaccatgatgcttgggcttaggatcttgaggcctgtcacatgggcagcatgtgcacaggggacagagtattcctctagcacacgcagctggggtaccagcc

SEQ ID NO: 3702 - DNA, 4761 bp, Homo sapiens
gccattttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcccgtgggctagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtctttcctttttttttcctcttcgccttttctttttttttccttttttctttttttttttttaatttttccccccaaccatcgtgatttgtcttttcatgcagattagttagaattcactgccaggtttcttctgcccaccaaaatgatccagtctggaataacattttgtaaaaaaaaaaaaaatatatatatatatatatagctgactggaagagattaatttcttcccccaacttcttgcatgttgaagatatttgagctatttttcatctaaaagagtaaggtattaggcccttttgtgggagccccatgttttgtttttctgagttggtggggagggagggagggggagggctgaattgttttgcagaggaagatggcatctgtgctttaaatttctcattactgggttagaaaacaaagagggagtgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatagtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaataa

SEQ ID NO: 3703 - DNA, 4014 bp, Homo sapiens
tggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggacttcctcaagcgcagggactatgtcttaaggcgctttgcagagccaagctcatttctggcacataagaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccgggaaaaaaaaaaaaaaaaaaaaaa

SEQ ID NO: 3704 - DNA, 3943 bp, Homo sapiens
tggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccgggaaaaaaaaaaaaaaaaaaaaaa

SEQ ID NO: 3705 - DNA, 4745 bp, Homo sapiens
gggggctagggggtggggctgcagccgggacggggccttcggcagggcctgcgggggcgggacggagcggacccgagtgatacccgggagactagcttggccacaggagacaacgttgaggtacagacaggattattcaagatcaggttgtagccattttcaacaaggatcactgatcaaaattttctttttacaaagagatttacaagttaaacatgaagggaaaatactggaatcatttggattctgacaggataaagaatacaatatttcacatttacttgtaatggaacctttgtaagattcatcacttgtcattcacccagttgggaacatggaagttggtttttctcgtactactgttcagacactgtcaagaagccactgcaaaaacatcaaacaaaaaatttctcaatgggaaggaagggctaatggtatatctaatccagaaaagtggtgtccaaaggactttggagtgagatataactgtcaccaagagatccgtcttaagaaaaatcctatagctgagagaaagagcaaaaacttggatgtaaccagccgtgaaaatgtgggtctagatataaatgaaaataccaaaagccatgatcaaagtgagaatgaaaataagaaacatgaatatgacgatacacacttctttaaaaatgaatcagaatccaactgggtatgttctcgggtcaaagaaattgaaagctgtaaagaagatgtcttagatccagagacttcattacctccaggaaacttctatacctcacaaatactgtggaagaaaatagaagcacttcccccagataaactcttaaatttggctttagaacattgtgactcttcagaaaaagaactgaacttcagagttctggatagttcatacggaataaccaagagcttagaaaatatttactctgaacctgaggggcaagaatgtggaccttccataaatcctttgccaaaacctcgtaggacattcagatatttatccgaatctggtgttacgccgtataaagaaagaaactgtgacaaaaaatactgtgaaaataactcttgtgcacaatcttctttggcctcttctcaggaacctgaaccaaagaaatatggtggaaaaatcagaggaagatctaaaaggaaatcctttgaatttgaggatattcagcactttcgaaatcggaactcacagacgattcgtgaagaacttggaagaaattctgggtcagcactttattacacacagtctgaggacaatatctatgaagatatcatatatcccaccaaagaaaatccatatgaagatattccagtgcagcctttacctatgtggagatccccttcagcatggaagctaccacccgctaaaagtgcttttaaagcacccaagcttgtattgaaaatagatgacatatttgaatctaaaagagggaagaagaaggtaaagttacattcttacactgggaaggaattacctccgacaaaaggtgaaaccagtgggaacgaaagtgatgccgagtatctgccaaagaatcgccataaacgcttagcacaactgcaaccgtcttccaagaggaatcctcactaccagaccttggagcgggatcttattgaattacaggagcagcagctgtttgaactttttgtggtggtgtctctacagaagaaaccatcaggaataagctatattccccaggtcatacaacaattccctggcaaggatgatcatggctataagcagtccaaagacatggaagagagacttaaagttattccaaaattttgttttcctgattcaaaggactggatgccaacctcagaactcaagagtgaaacattctcctttgtcttgactggtgaagatggaagccggtggtttggttactgtaagaagctcttgccagtaggcaaaggaaagcgactccctgaggtatactgcatggttagtcgcctaggctgcttcaatcttttttcaaagattctggatgaagtagagaagagaagagaaatgtctccagcccttgtttacccattcatgcgaagtgtcatggaagctcctttcccagctcctggacgcaccatcacagttaagagttacctccctggggctggagatgagtccattgaactctgccgaccactagattcccgattggaacatgttgattttaaatgtctctttaagtgcctgagtgtgtgtcatctcatccgggtctgtgcctctctccttttggagcgtagggtaatctttgttgccaacagcctaagcaccctgtcaaaatgtggccatgctgtggtagctacactgtatccgttcacctggcagcatacctatatcccagtcctgccagcatctatgattgacatcgtgtgctcacctacaccattccttattggaatcctgtcttgctccttaccacagctccaggacctacccattgaagaggtgctgatagttgatctctgtacagacaagttcttacaggaggtatctgatgaggatgaaattctaccaccaaaacttcaagctgccctgatgcagattttggaagaacgaaatgaaatcttgactcaggagcagaatttttcacaagatgtgacactcaactctctggtgtccgaagcatttgtcaggttttttgtggagttggtaggacattattctttgaacatgactgtcactgagcgtggggagcgtgttttccaaagggaaccattccgtaagtcccacacctcccgaagtgtacgccacttcctggatctcttcatggaaactcagatgtttgcaggattcatccaggaccgagagcttcggaaaagtggagttaaaggtttgtttgagatccgggccatccagtatttggaaacaattcctgagtcggagcccagtgggatgaatagaattttgcggagtcttggaagcaaaatgaaatttctgcaaaagaaatgaaatctctgattgtctccatcctgaatatacaacagaaagtgccaaagaaaatatttttctaagggtcaggatcccatgaagtattctacaaaattcttgaaattttaaaaggttaaagagcgagtcaggctgtcagaggaggattctcctgttgctgctgtagtaatcactggagaattgttgggaatggtctggcaccatgccatctttactctgtctccattttttttttatagcagccttttctatgtgattcttgggctcattctctgttttgtgctttgtctgtgaaagtagttgtgtttcacaaggaaaagccttgttgttgttacatttaaaaaatagctcaaagatgagaataatgagagaaatgctgagtttaaggtagtagagagacatgatggaaatggagaacactagccttatacacataattctcatcactgaactatcatggcccctttaaacccatgggctgtttgacctgggctaaggaatagactcatcacatatctccattgttttgccttatattatatctaggggaatctcacttaggaggaagccctacttgtaatattataaggtactgttattaagtaccttataaaattagacatcttgcaactcctcctccaaattatgtggcatttgagtagtttgcttgtgcctcacatgtcaacattaaactttgtggaggctggatgcagtggctcacacctgtaatctccaccactttgggaggctaaggcaggagtttgagggtgggagtttgagactagcctgggcaacatagcaagatcccatctctacaaaaacattttaaaaataagtaaataaatttaaactttgtgaaattatagctaatatgaaaatgtcctttcaagggcatgggagccacctttattttttagtgtccaccatgtgccatgcactgtggtatatgtatgcatatcatctcaaccaatccttaaatcaaccttatgagatagatatttgcatctccattttactaataaactgaggctgggattacaggcatgagtcactgcacccggcctgtgtgtgtgtgtgtgtgtgtgtgtgtgtgttttcaaactcatgggcaaattcaagttcagatggtgcacttttcattgattaatgttatagcaaatgtcagtttgttttcttcagtttctgctgatggttttaactggcacagaaagtatttattcaaccttacaaaactgtgtaagttgtattgtgatacagtttattgacttgtacagtattgtcattacaacccattcaggtatgcatgaatctgaagcagaacaccatttaagactggtgctgtataatataattcctacagatgtgggtccagggaatagaactgagcctgtcttttttttaatgttaagcaggttacccccagtggggcttctactagacatctctccatttggtctcttcttacactccaacccagcaggaacagttaataattggatgtttataaaatgggggtaaaagggtttactgtgatggatcctggctatccctctaggaggagacctttgcttcagcaatggtgtcttcatcctcgcagcctgaagctgcttcatttccttaggtctgttgtgttttctgtaaagtgttaggaattctggatatttttgtaaaagaatcaagatttgtataaaatgttgtttacagatcttttaatgaataaatacataaaccccccacagaaaaaaaaaaaaaaaaaaaaaaaaaaaaaaaaaaaaaaagaaaaaaaaaaaaaaaaaaa

SEQ ID NO: 3706 - DNA, 5113 bp, Homo sapiens
cgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgagcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttacgacacctcagtttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagaaaagtccccgagagcacttccaggctgggcctttctctccctgttctcccacccctcccggtcagtcaccaaacaggtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggtttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaag

SEQ ID NO: 3707 - DNA, 3146 bp, Homo sapiens
ttgccttgactacggcgggcgctgtgggagtggagaagctgcaagtgctgaggcgcggtggaggaaagcatgggagccaagagtatgaggagctggtgtctgtgtcagatttgtagctgcgggtcggattattgtccttatgaaatagttaaacagcctcgccatgtgccagaagaatataaaccaaaacaagggaagattgatcttggtactacctacaaacgggatttgaattcgtataaagtgcagcctgtggcaatagtccggcctttggagagacaagttaaaaaaggaaaattggacactgtcccaacctataaagacgattatagagcttgggaccttcataaaagtgaactttataagccagaacaaacttaccacccgcctactgtgaaatttggaaattcaactacatttcaggatgattttgttcctcaggagataaagcctaggcaaagctttaaaccctcctctgtggtcaaacgttctacagccccttttaatggtattacaagtcatcgccttgattatatacctcatcagcttgaactcaagtttgaaaggccaaaagaagtttacaaaccaactgaccaacgctttgaggatctcacaactcaccggtgtgactttcagggtctcattggtgaaactgcaaaactctgcagacctgtacacaccagagtgacccagaatgctctgtttgaaggaagcactgaattccgtgaaagttttcaaccatgggaaatcccaccacctgaggtcaagaaagtaccagagtatgtgcctcctacaggtagcatgctgttaaacagcacaagccatcttgactatgttccatatcaggccaaccatgttgttcccatcaggccagtttctcaaaaaagaagtaacaattttcctttccaaggaaaaagcatcatgaaagaagattttccagcatgggaaagttgtcgtcaaggacttattaagaagcagcagcagattcccaacccatctggaaaatttgatggtttgagcactttcagatctcactatgtgccacatgaattgatcccaacagagagttgcaaacctttaaatattgcttttaagagttctgttccatttgatgatgtaaccatgtactctgtagagtacacaccgaaaagacaggaaatttgcccagccagctatccctctcctccaggttatattttcgacaatacaaattcccaaggtcataaattcttccgcaagattattcctgcagtgaaggccttctaataaccaaaatgtgcttaaaaggaaggtactagcaagttgttgtttttccaagagaaaactcaatttttatagttaaaaaatttatgatataataaatcattttttatatttttaaacaagaaaattggaaaatatattataagaaatcagaatcttaaaaccattttttattgatattttaatcaagattgttctttaatgtgcatttcagaaggttgaataatatgcattcccatgagaactattttagtattcaacatactgcttagtagcttgtccccagtctattatcatttgtaattctgtttataattatggcaattgtatggttattcacataccatttgtcatttatcaagcacatcaggattatctagaacaacattgaaaatgatacatggattcctcttccaaggcaacaggattcattatactcagacttcacggcatctacatagcatccactgaatcaagttttggttggtggtatacagactgctgcactgctcctcaccatgttcaagttagcaagaggcactgtggtgtggcaaggaaaggctctgtgtgctgggaatcgaaggacttgagttcaagttctgactaataattattattatttttagagacagggtctcactgtcacccgtgctggagtccagtggcataatcacagcttactgcagcctcagcctcctgagctcaagtgatcctcctgcctcagcctcccaaatagctgggactacaagggtgtgccaccacacctggctattttttttaaacatactttgtagagacaggttcttgctgtattagtcaggctgttcaatctattggccaggctgctattgaatcccaccttggcttcccaaagcactgggattacaggcatgagccactatacccaacctgagtttaagttctaataatatagatttctatttgtactaccttaggcagtgactcatatctctgagcctcagtgtctttatttgtaaaatgatgtctgttctcaaaaagagtttgttttgagcatcagactgtatggtacattttaatccttaaagtacaaatgtggaggatttttttttaaaattgctcaatctctttttgtacttgttttctccttttcaaattaggataattacttactcaatgctcattttctggcctgtagcaaggattgtaaaataacctaatttgctttgagcttatgagtagtatatacttctgagaggagtcttgtcctttaaaacttcatgagcacctgagaaattcttaacagagaatggaaagcttggaatggggtaaatacagtggtttgaataacagtatttgcagaaaggaaaaagtattatttgctagggtagttttaggaagactgacagctctgaagaaatctttagggtaaatgtaggtaattttgcacctaattgccaggccaagtcactgtttagaggaagaaccagccccagcagggggcataatcacctggttcacctcttccggtgtgaagataagtgataaggtaaagaatgatgccagtaagtatagtagaaacactctattgcatttataaatgctaaaaatttccgaatgaattaaactcttattgggtggtttctttttttaaaaaaattaaataattgcattatgggagaatatgatttattttagcataaagtgaattttagtcttttatggcttcagaattatttcaaaatatactttattgaaaatcaatatttggttattttaattgttcaaaagtaatttgttctttacatttattagtaaaagtatggtgtgtgaaactatatttccatgcaacataataaaatcaataaaaggaatggattttcaagaaaaaaaaaaaaaaaaaa

SEQ ID NO: 3708 - DNA, 3175 bp, Homo sapiens
cttcggcgcagggctccggccaacacagccctccaggccgcctactctccagccagccggctccacggacccacgaaagggcaagggggcggcgtcggggcggcgggacagttgtcggagggcgccctccaggcccaagccgccttctccggcccccgccatggcccggggcggcagtcagagctggagctccggggaatcagacgggcagccaaaggagcagacgcccgagaagcccagacacaagatggtgaaggagacccagtactatgacatcctgggcgtgaagcccagcgcgtccccggaggagatcaagaaggcctatcggaagctggcgctcaagtgccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatttatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaacactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaacctcccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccactgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagccggtatgagagat

SEQ ID NO: 3709 - DNA, 2371 bp, Homo sapiens
agctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaagcatatgaaacactctcagatgctaatagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcactaaatccaactggttgactcttcctcattatctttgatgctaaacaattttctgtgaactattttgacaagtgcatgatttcactttaaacaatttgatatagctattaaatatatttaagggttttttttttttgacaaattcaacattcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccatatgagtattaatcctatggatacatattaaaacaagtgtctcatacaacattgtatgtgagagaaatataaatatttacaacctgatattcgttgttgttttattgttaaaagtttattatgcaactctggaggtatagagggcatataagctatgggacatatgctgatcacaggctatattcatgaagttacttttgaccaacctgaaaactgataggattttgtttgtcatttggtaatttctactgcattcttaccatccttctctcacaaattttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataataataaaattagctataccttgaa

SEQ ID NO: 3710 - DNA, 2382 bp, Homo sapiens
aagagggaagtcgtggtggtcgcgagggagccggaaagatggtggttaccagatctgcacgggctaaggccagcatccaagccgcgtcggctgaaagttccgggcaaaagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagagacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcacgaacaggccaatgttgaatctcttaaagaaacaaaacagaattgtaaggatttggatgaagatgccaatggaataacagatgaggggaaagaaattaatgagaaaagttctcagctgaagaatctttctgaacttcaggacactagccttcaacagttagtttctcagagacattcaaccccccaaaataaaaatgctgtatcagtgcactctaatctgaactctgaggctgtaatgaaatcattaactcaaacatttgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagattttgaatgtgataccaaactatacacgtctgcgcccaacacatctcagggtaaagataattctgtcttactagttctcagcagtgatgaaagccaacagtctgaaaacagtgagaatgaagaggatactttatgttttgttgaaaatagtggccaaagggagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatgaagaagacttcctaaatagcacaaaggctaaacttctgaagttgacaagcagcagcatagaccctggtctgagtatcaagcagttgggtggtttgtatattaattttaatgcagataaactacagtctaacaagagaaccctaacacagatcaaggagaaaaagaaaaatgagcttctgcagaaagccgtcattacacctgattttgaaaaaaaccactgtgttccaccatatagtgaatcaaagtatcaacttcagaaaaaacgcagaaaagaacgacaaaaaacagcaggggatggctggtttggtatgaaagctccagaaatgacaaatgaactgaaaaatgatctcaaagcactgaagatgagagccagcatggacccgaaaagattttacaagaaaaatgatagagatggcttccccaagtacttccagattggaaccattgttgacaatccagctgatttctaccattcacgaattcccaagaagcaaaggaaaagaactattgtggaagaactgctggctgattctgaattcagaagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaaagacgtttggaaaactaaaa

SEQ ID NO: 3711 - DNA, 3763 bp, Homo sapiens
attcgaggcgccgaggagccgaagaccacagctcagctcagacggcgccctagggccgcacagagggtcgggcagtgccggagagaggtttgaaagcgccgccgccaactcgacagcgcgtcccagcgccttgagctcgcttcctcctgctctcaggaaaaactgaggaaacgcgcctggttccaggggtcggcggggaccgtggagacgctgccagcatcctcaacagcttggaaatcccatcaccttggttccctgagacttggaggactagtaggaactgacagctggctgacagaaaacttatccagggagagaagagacaaaagtgaagtgtgaaattttgaataatgttttcagatgctttgcattcagaatagacctctgagttgggacccaagctgtcaactgatcccaaattcctaagttcctgacttgcaggtattgagttctaacctccgaagatggatgaaggtatggaaatttcaagtgaaggaaattccttgatcaaagcagtccatcagagccggcttcgcctcacaagacttttgctagaaggcggtgcctacattaatgagagcaacgaccgtggggaaacccctttaatgatcgcttgtaagaccaaacatgtcgatcaccagagtgtcagtaaagccaaaatggtgaaatacctgttagagaacaatgccgatcccaacatacaggacaaatctgggaaaacggctctgatgcatgcttgcttagaaaaagctggccctgaagttgtttccttgctcctcaagagtggggctgacctcagcttgcaagaccattctagttactcagctcttgtttatgctataaattcagaagatacagagaccctgaaagttcttcttagtgcttgcaaggcaaaagggaaagaggtcatcatcatcacaacagcaaagtcgccctgtgggaagcatactactaaacaatacttaaatatgcctcctgtggatatagatgggtgtcattccccagctacctgcaccactccttcagaaatagacatcaaaactgcctcatcgccactttcacattcttctgaaacggaactgacgctttttggctttaaagatcttgagcttgctggaagcaatgatgatacctgggacccaggttcccctgtgaggaaacctgcattggcccctaaggggcccaagctcccccacgctccaccctgggtcaagagtcccccattattaatgcaccagaacagagtggcttcattgcaagaggagctccaggatattacaccagaggaagaactatcctataaaaccaatgggctggcactttccaagcggttcatcactaggcaccaaagcattgatgtaaaagacactgcacatttgctaagagcctttgatcaggccagctcaaggaagatgtcatatgatgaaataaattgtcaatcttatctttcagaaggaaatcagcaatgcattgaagtccctgttgaccaggacccagattctaaccagacaatatttgcttccaccttaagaagtatagttcaaaaaagaaacttgggggcaaatcactacagctctgattcccagctctcagctggccttacccctccaacttcagaagacggcaaagcacttataggaaagaaaaagatcctctcaccatctccttcccaattgtcagagtccaaagaattgttggagaatatccccccaggtcccctgagcaggagaaatcatgcagttttagaagggcgaggttcaggagctttccctttagatcacagtgttacccaaaccagacaagggtttctcccacccttaaatgtaaattctcaccctcccatctcagatatcaatgtcaacaacaagatttgcagccttctttcttgtggtcaaaaagtgcttatgccaacagttccgattttccctaaagaattcaaaagtaagaaaatgttgttaaggagacaatcattgcaaactgaacaaattaagcaattagtaaacttctaggagatgggtataaaacacatcttcttcaaatgtttatatcagagaaacaaagaactagagaagaaatcttaaatgttcattcttttaaatctcgtgattggttagtccataatggctagatggattaaaatgtaatgtgatttgtactaggcgtcatgagcataaaaaataatacatagtttctgttaagggaattctctcaaacgaaaggaaagcgatttttctcaatgcttctaatatttaacaatctccatgtagtccaaatttgtcattaaaaaaaaatcaaagaaagaaggccacgtatgttggggtaatttttaaaaattttcagattggctaaatattttattaggaaacagttttcaagtcaataatttttttaacatttcatgttaataaatgagattgaaattttttatgatctctaaaccataaaagaaaacaccgacagctgtaaaatgttctaagataaaaaaactcgagctacaaagaaagaatgaactaattctttacaaatgttgactgaagatagataaaactctaattaaaaatttaaaaggttaaacactgtattagagtgggcaactaaaatattcgtggtgtcagtttaattagtgtcaaactggcaagtcagagttttacaacctactagtaatctatgccgggtcttgttgtttgtgcactgtgttttgctttgctttgttttggtttttaaacagacttacctgtaaagttatcttacggaattattctttctccatatcttttaaggaattattctttctccatatcatcttttaattcctgttattagttttggaagcttatccataagtttccaaagacaagatgatataaaagttaaaaagcattcctctttacttatatcaaattattcttgtctttcaaaaagaaccaaaaaaaaaaaattcatcatggataaaaactaagcgcttgccttcttttaaaaagaaaaactgatgattagattaggttagctaaaattaatagaggcagtagaaacttaatcacaaaatgtactaaatatttggcaatattaaacaatgcctttttatttctgatatgtagttattagacatttatatattaaggataacttccttagtgtgacattccaatcatttagtattttaggacctgtgaataacttccaacaaaattaatgaataccatattagtattataaaatattataaagtaataattatatcatctatataacttcaaagtatgatgtttatacaaagaatccttatttcagtctagcagcttaacaacaaaggataaatcagactatacaaaacctaagtgtattaatttgatgattgtcacgtacaactttctttgccttccaagtagaggtgatcctaacaattggcatgatgcttttcttggtaatttgatataagcaagttgtaatgtacatagtaattatttaattactgtggcttttattttaaaaagtaattagaggtttttccatttcatgtcttgaacaacattaatattaattacactagaaatattttttgattcagaacttagaattgtacctgatatttataggtatttaaatgctttctgcaagttaaatatcgagaaaagtacttgacttcaagttgtaaggatacaatttggaagggtatgtaaatagattagttcataaacaaaatggtatcaataaagattttaaatatcaaaaaaaaaaaaaaaaaagaaaaaaaaaaaaaaaa

SEQ ID NO: 3712 - DNA, 3373 bp, Homo sapiens
ggctcgctgcctcgcattgccacaggctcctgagaggtcgcgggcagtgcctgcggggaggcgcggggccctgctctgtagggctgaaggccgcccgaggttcgccaaggctctgggctctcgaaaggaagccaagaaaagaagctgcccaggtgaccagtcctgggagtgctctctcccaaggaagctccgagcgcccaggagcccttagccggggtctagtgccctttgaacaatctccagctcttcaaggaagtgggctgccgccgcctctcttgggacctggcctgggatcctttccccaaacgcaccccggcgatttttgcgcaccgggagccgaacccctgctgcgcgcagctggctgggctcaggcgcgcttcctcaacgtttcggagccgctgcccccagcgaagtccacattccaagctccaggggctttgagagagacgaccccaaggcaaggcgtttggagagctgctgaggagccaggggcttggaggagcgagaagacatgtattttcagctgagtctcagaaggggagaatctcctgtcaccaccagaaaagcaacagccccgaaatgtgattgcaactgactagcagagcagaggcccaggagtcactggattgatgatttagaatatgctaaaaagccagtgctttatttggggaattcaggggctttctggtgcccaagacagtgacctgcagcaagggagtcagaagacagatgtagaaatcaagagtgaccatccacgggattgacttggattgccactcaagcggtcctctcatggaatgttggtgaggccctctgccagggaagcaatctggctgtgcaaagtgctgcctggtggggaggactcctggaaatctgactgacccctattccctgcttgggaacttgaggggtgtcagagcccctgatgtgctttctcttaggaagatgaggactctgaacacctctgccatggacgggactgggctggtggtggagagggacttctctgttcgtatcctcactgcctgtttcctgtcgctgctcatcctgtccacgctcctggggaacacgctggtctgtgctgccgttatcaggttccgacacctgcggtccaaggtgaccaacttctttgtcatctccttggctgtgtcagatctcttggtggccgtcctggtcatgccctggaaggcagtggctgagattgctggcttctggccctttgggtccttctgtaacatctgggtggcctttgacatcatgtgctccactgcatccatcctcaacctctgtgtgatcagcgtggacaggtattgggctatctccagccctttccggtatgagagaaagatgacccccaaggcagccttcatcctgatcagtgtggcatggaccttgtctgtactcatctccttcatcccagtgcagctcagctggcacaaggcaaaacccacaagcccctctgatggaaatgccacttccctggctgagaccatagacaactgtgactccagcctcagcaggacatatgccatctcatcctctgtaataagcttttacatccctgtggccatcatgattgtcacctacaccaggatctacaggattgctcagaaacaaatacggcgcattgcggccttggagagggcagcagtccacgccaagaattgccagaccaccacaggtaatggaaagcctgtcgaatgttctcaaccggaaagttcttttaagatgtccttcaaaagagaaactaaagtcctgaagactctgtcggtgatcatgggtgtgtttgtgtgctgttggctacctttcttcatcttgaactgcattttgcccttctgtgggtctggggagacgcagcccttctgcattgattccaacacctttgacgtgtttgtgtggtttgggtgggctaattcatccttgaaccccatcatttatgcctttaatgctgattttcggaaggcattttcaaccctcttaggatgctacagactttgccctgcgacgaataatgccatagagacggtgagtatcaataacaatggggccgcgatgttttccagccatcatgagccacgaggctccatctccaaggagtgcaatctggtttacctgatcccacatgctgtgggctcctctgaggacctgaaaaaggaggaggcagctggcatcgccagacccttggagaagctgtccccagccctatcagtcatattggactatgacactgacgtctctctggagaagatccaacccatcacacaaaacggtcagcacccaacctgaactcgcagatgaatcctgccacacatgctcatcccaaaagctagaggagattgctctggggcttgctattaagaaactaaggtacggtgagactctgaggtgtcaggagagccctctgctgctttccaacacacaattaactccgtttccaaatacattccagtgtattttctgtgttgttcatagtcaatcaaacagggacactacaaacatggggagccataagggacatgtctttggcttcagaattgtttttagaaatttattcttatcttaggatttaccaaatagggcaaagaatcaacagtgaacagcttcacttaaaatcaaatttttctgggaagaaaatgagatgggttgagtttgctgtatacaaacaggtgctaacactgttcccagcaaagttttcagattgtaaaggtaggtgcatgccttcataaattatttctaaaacattaattgaggcttacagtaggagtgagaaatttttttccagaattgagagatgttttgttgatattggttctatttatttattgtatatatggatatttttaatttatgatataataaatatatatttatcatatttaataggataaattaatgagttttatccaagaccttacaaccacatttctggccatttaactagcactttataagccaatgaagcaaacacacagactctgtgagattctaaatgttcatgtgtaacttctagaaacacagcagaaactgatagataagggaataaagttgaaatgattccttaaaattcatggacacagataaatgcaaggtgagaattgacaaatgctataaatgctttctttttctgaaaagattttgaaaaatttaaaaaagtatagctactactgtgttcaaaacgttttaaatgacaaatgactttcccaggggaatttgcagttctgtaaatatcttaaataaaagccaacttaagaagagcccagcattaaatttacgatcttaggtggtaatgaaaagtatatgctgctttgtatttatgtaaaataattggccctctccatcttttctcatttcatgtgtcaggtagtttttctga

SEQ ID NO: 3713 - DNA, 3499 bp, Homo sapiens
gggaagtgggagagacagagggagagtgtgcatacagcagctgtcgggcatccctgtctcagggacttcttcgctgattcacagaggcagcccagccccggcctcccagcttacactgccgcctgcttctcagaacctgacggaatcagaagctacatgatattcgccgtgtgagtggctatcgtaatagataacatttgaatatctactaaatgccagaaactatgaattaactcctctcaacaaagctaagaggtgcttgatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccgcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggcctttatggaagaagtcaagtctcgggccccctacatctattctgtgctggagtcagctcaggccttcctgtcccagcacccatttgaggagttagaggagcctcattctgagagcaaagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctaagccaagctgagggagtccgagccacttgggagcccattggggatctcttcattgattcactcccagagcacatccaggctattaagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggcgtcagttgatgagaggcttaagcagctccaggatgcccaccgggactttgggcctgggtcacagcactttctctcctcctctgtccaggttccctgggaaagagcaatttcacccaataaagttccctactacatcaaccaccaggctcagaccacatgctgggaccatcccaagatgacagagttataccaaaccctagctgatctgaacaacattaagttctcagcttatcgcactgccatgaaactccgcagagtccagaaagccctgcgcttggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaatgtgccactctgtgtggacatgagcctcaattggctcctcaatgtttttgatagtggtcgcagcggaaagatgcgggcattgtcttttaagactggcattgcatgcttgtgtggcacggaagtgaaggaaaaacttcagtacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttagcaccgggaagccagtcattgaagcatcccagttcctggagtgggtcaacctggagccccagtccatggtgtggctgcctgttctgcatcgggtaaccattgctgagcaagtgaagcatcagaccaagtgctctatctgtaggcagtgccccatcaaggggttcaggtaccggagtctgaagcaattcaacgttgacatctgccagacctgcttcttgacaggcagggccagcaaaggcaataagctgcactaccccatcatggagtattacacaccgaccacatccagtgagaacatgagggactttgccacaaccttaaagaacaaattccgctccaagcattatttcagcaaacaccctcagcgaggttatctgcctgtgcaatcagtgctggaggctgactacagtgagacgccggcttcttccccgatgtggccacacgccgacacacactcccgaattgagcattttgcgagcaggcttgctgagatggaaagtcaaaattgctccttctttaatgacagcttgtccccagatgacagcatagacgaggaccagtacctgctgcggcactccagccccatcacagaccgggagccagcctttggacagcaggctccatgcagtgtggctacagaaagcaaaggggagctacagaagatcctggcccacttggaagatgagaaccggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcagccacccaccgaatcagatggcagtggctctgcaggctcgtccctagcttcctctccacagcagtcagaaggcagtcacccccgggagaagggacagaccactccagataccgaggctgcagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggag

SEQ ID NO: 3714 - DNA, 2496 bp, Homo sapiens
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaggaagagcaaaagcaggcagctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaa

SEQ ID NO: 3715 - DNA, 2406 bp, Homo sapiens
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaggaagagcaaaagcaggcagctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaa

SEQ ID NO: 3716 - DNA, 2314 bp, Homo sapiens
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaggaagagcaaaagcaggcagctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaa

SEQ ID NO: 3717 - DNA, 2433 bp, Homo sapiens
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaggaagagcaaaagcaggcagctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaa

SEQ ID NO: 3718 - DNA, 2315 bp, Homo sapiens
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaaaaaaaaaaaaaaaaaaaaaa

SEQ ID NO: 3719 - DNA, 1665 bp, Homo sapiens
gttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagggaagatcctggtgcattgtgctgtgggcgtgagccgatccgccaccctggtactggcctacctcatgctgtaccaccaccttaccctcgtggaggccatcaagaaagtcaaagaccaccgaggcatcatccccaaccggggcttcctgaggcagctcctggccctggaccgcaggctgcggcagggtctggaagcatgaggggagggggagagaggtcaggccaggcccgtgggtaggtccctggctcccagctggagataggaggcccaggtggcaggtagcaggaggcccagatcacccatcctcccctggggtcaggagaggccgagccccaggccactgtcactctttgtgggaggggacggggagtgaggttgggcagtgtggtggatgggcacccaggaagggttgaccagggaaggaggcagctaggctgtagatggaagatggtcctgggattcgaacaccgctgggatctggccagggtgctccctgggattcacagtcccttcccctctttgtgcccaagtgtttccctctctccctcaccaaaacaaaagggccatctctgccctgcacttgtgcagaaagtcagggatacggcaagcatgaatgcaatggtgtagagttgtgtgaaacccctagcatagagacagacagcgaagagatggtgtgaaaagcttgcagaaccagacagagaaccccacagactttccactccaagcacaggaggaggtagctagcgtgtgagggttggcactaggcccacggctgctgcttgggccaaaaacatacagaggtgcatggctggcagtcttgaaattgtcactcgcttactggatccaagcgtctcgaggataaataaagatcatgaaaaaaaaaaaaaaaaaaaaa

SEQ ID NO: 3720 - DNA, 5319 bp, Homo sapiens
ctgatttcgtgcgcttcctcgtccttcatgttggatggccagtttttcgtttgtgcgtcatcctctacctgagaaatggtcgcttgcccctagtctagacacgcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagaccccttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagttaccttgtgagataaatgttctttgcttcatattcacagtttcacctccatttaaatttatggggaagaataaatgtttcctgactcagaaacaattttgcctccatatttcagtgcaaatatattttgaagttacttttaaatatttatttaaaacctctgtttctgtaactgtatgttaaacgtattcttctgtaatgagaatagactggaacatgtgagggaaaaatattaaaaaaaagatggcagtcatctagacatgtaaaatgccaagaatgtcttagaattgcacaatttagaatttatagagcctttaatcaccttgtctagcaccttgtattagtccattttcatgctgctgataaagacatacctgagattgggcaatttacaaaagaaagaggtttaatggacttacagttccacatgactaaggaggcctcacaatcatggtggaaggcaaagaggagcaagtcacatcttacatggatggcagcagacaaggagagagagcttgtgcagggaaactcccatttttaaaaccatcagatctcatgaggcttactatcacgagaacagcatgggaaagacctgcccccgtgattaaattatttcccaccaggcccctcccacaacatggaataatgggagatacaagatatttgggtggagacacagagccaaaccatatcacaccttaaggtcatggtcatatagctagttatcttgtaaaaccaatgtttcttagttcatacttacaactgcaatttcactttcatttagaaaagaataaatgtttcttaattgaacaactaaaaaaaaaaaaaaaaaaaaaaaaaaa

SEQ ID NO: 3721 - DNA, 2872 bp, Homo sapiens
cggcgctgggagacaccggacgcccgctcggctgcgctgcggctcaggcccccgctcgggcccgacccgctcggtcaccgccggctcgggcgcgcacctgccggctgcggccccagggccatgcggaggcccacgaggaggccggcggccacgcgcatcccgtagcccaggtggcccaggtctgcaccgcggcggcctcggcgccatggagcccccgtattcgctgacggcgcactacgatgagttccaagaggtcaagtacgtgagccgctgcggcgcggggggcgcgcgcggggcctccctgcccccgggcttcccgttgggcgctgcgcgcagcgccaccggggcccggtccgggctgccgcgctggaaccggcgcgaggtgtgcctgctgtcggggctggtgttcgccgccggcctctgcgccattctggcggctatgctggccctcaagtacctgggcccggtcgcggccggcggcggcgcctgtcccgagggctgccctgagcgcaaggccttcgcgcgcgccgctcgcttcctggccgccaacctggacgccagcatcgacccatgccaggacttctactcgttcgcctgcggcggttggctgcggcgccacgccatccccgacgacaagctcacctatggcaccatcgcggccatcggcgagcaaaacgaggagcgcctacggcgcctgctggcgcggcccgggggtgggcctggcggcgcggcccagcgcaaggtgcgcgccttcttccgctcgtgcctcgacatgcgcgagatcgagcgactgggcccgcgacccatgctagaggtcatcgaggactgcgggggctgggacctgggcggcgcggaggagcgtccgggggtcgcggcgcgatgggacctcaaccggctgctgtacaaggcgcagggcgtgtacagcgccgccgcgctcttctcgctcacggtcagcctggacgacaggaactcctcgcgctacgtcatccgcattgaccaggatgggctcaccctgccagagaggaccctgtacctcgctcaggatgaggacagtgagaaggtcctggcagcatacagggtgttcatggagcgagtgctcagcctcctgggtgcagacgctgtggaacagaaggcccaagagatcctgcaagtggagcagcagctggccaacatcactgtgtcagagtatgacgacctacggcgagatgtcagctccatgtacaacaaggtgacgctggggcagctgcagaagatcaccccccacttgcggtggaagtggctgctagaccagatcttccaggaggacttctcagaggaagaggaggtggtgctgctggcgacagactacatgcagcaggtgtcgcagctcatccgctccacaccccaccgggtcctgcacaactacctggtgtggcgcgtggtggtggtcctgagtgaacacctgtccccgccattccgtgaggcactgcacgagctggcacaggagatggagggcagcgacaagccacaggagctggcccgggtctgcttgggccaggccaatcgccactttggcatggcgcttggcgccctctttgtacatgagcacttctcagctgccagcaaagccaaggtgcagcagctagtggaagacatcaagtacatcctgggccagcgcctggaggagctggactggatggacgccgagaccagggctgctgctcgggccaagctccagtacatgatggtgatggtcggctacccggacttcctgctgaaacccgatgctgtggacaaggagtatgagtttgaggtccatgagaagacctacttcaagaacatcttgaacagcatccgcttcagcatccagctctcagttaagaagattcggcaggaggtggacaagtccacgtggctgctccccccacaggcgctcaatgcctactatctacccaacaagaaccagatggtgttccccgcgggcatcctgcagcccaccctgtacgaccctgacttcccacagtctctcaactacgggggcatcggcaccatcattggacatgagctgacccacggctacgacgactgggggggccagtatgaccgctcagggaacctgctgcactggtggacggaggcctcctacagccgcttcctgcgaaaggctgagtgcatcgtccgtctctatgacaacttcactgtctacaaccagcgggtgaacgggaaacacacgcttggggagaacatcgcagatatgggcggcctcaagctggcctaccacgcctatcagaagtgggtgcgggagcacggcccagagcacccacttccccggctcaagtacacacatgaccagctcttcttcattgcctttgcccagaactggtgcatcaagcggcggtcgcagtccatctacctgcaggtgctgactgacaagcatgcccctgagcactacagggtgctgggcagtgtgtcccagtttgaggagtttggccgggttttacactgtccaaaggtctcacccatgaaccctgcccacaagtgttccgtgtggtgagcctggctgcccgcctgcacgcccccactgcccccgcacgaatcacctcctgctggctaccggggcaggcatgcacccggtgccagccccgctctgggcaccacctgccttccagcccctccaggacccggtccccctgctgcccctcacttcaggaggggcctggagcagggtgaggctggactttggggggctgtgagggaaatatactggggtccccagattctgctctaagggggccagaccctctgccaggctggattgtacgggccccaccttcgctgtgttcttgctgcaaagtctggtcaataaatcactgcactgttaaaaaaaaaaaaa

SEQ ID NO: 3722 - DNA, 2911 bp, Homo sapiens
gggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagcgagccgtacagatcccgggctctccgaacgcaacttcgccctgcttgagcgaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagaaaaaaaaaaaaaa

SEQ ID NO: 3723 - DNA, 2813 bp, Homo sapiens
atcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaaaaaaaaaaaaaaa

SEQ ID NO: 3724 - DNA, 2782 bp, Homo sapiens
cgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttaaaaaaaaaaaaaaaaa

SEQ ID NO: 3725 - DNA, 2997 bp, Homo sapiens
gcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagttgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacgtttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttgggctcccacataagcactagtctatagatgcctcttaggactggtgcctggcacagccgcgggccaggaggctgccacacggaagcaagcagatgaactaatttcatttcaaggcagtttttaaagaagtcatggaaacagacggcggcacctttcctctaatccagcaaagtgattccctgcacaccagagacaagcagagtaacaggatcagtgggtctaagtgtccgagacttaacgaaaatagtatttcagctgcaataaagattgagtttgcaaaaaaaaaaaaaaaaaaaaaaaaaaaaaaa

SEQ ID NO: 3726 - DNA, 4536 bp, Homo sapiens
agctcagtgtgtggtgagcggcggcggcgcggccgggccggggagcgggcgcggcccggcggcctcagcatggaggacggcttctccagctacagcagcctgtacgacacgtcctcgctgctccagttctgcaacgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagattaaacagatctgtgagtcttctcaatgcttgcaaactgaatagatcgacaccaagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaagcaaacccaaggagcctgtattcagtgcagaagaaggctatgtaaaaatgtttcttcgtggacgccctgttaccatgtacatgcccaaagatcaagtggattcttacagcttggaagcaaaagtagaacttccaaccaagagactcaagctggaatgggtctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtgcctagcagttcatcctgatcggatcacgatagcaacaggacaagttgcgggcacatcgaaggatggaaaacaattgcccccacatgtgcgcatctgggattctgtgacattgaatactctccacgtcattggaataggtttttttgaccgagcagtcacctgtattgcattctcaaaatctaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggagattccagaacagtttggtccaatacggacagtggccgaggggaaaggcgatgtgatcttgattggcacaactcgaaactttgtcctgcagggcactctgtcaggggacttcacacccattactcagggtcacactgatgagctctggggactggccatccatgcctcaaaatctcagttcttgacctgtgggcatgacaagcatgccactctctgggacgctgtgggtcaccgtcccgtctgggacaaaataatagaggatccagctcagtcttctggttttcatccttcagggtctgtggttgcagtcggaacactcactgggaggtggtttgtgtttgacacagaaacaaaagacttggtcaccgttcacacagatggaaacgaacagctctctgtaatgcgatactcaccagatgggaatttcttagccataggctcacatgacaactgcatctatatatatggcgttagtgacaacgggaggaagtacacgcgagtgggcaagtgctcgggtcattccagcttcattactcacctggactggtctgtaaactcacagttcctcgtgtcaaattccggagactacgaaatcctctactgggttccctctgcctgtaagcaagtcgtaagtgtggaaactacaagagacattgaatgggctacctatacctgcactttgggattccatgtttttggagtgtggccagaaggctcggacggaaccgacatcaatgccgtctgtcgggcccatgagaagaaactcctgtcaacaggcgacgactttggcaaagtgcacctcttctcatacccctgctcgcagttcagggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacacccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttattatgaatgaatgaatgaatttgatggatttaaaaaaaaaaaaaaaaaa

SEQ ID NO: 3727 - DNA, 4479 bp, Homo sapiens
agctcagtgtgtggtgagcggcggcggcgcggccgggccggggagcgggcgcggcccggcggcctcagcatggaggacggcttctccagctacagcagcctgtacgacacgtcctcgctgctccagttctgcaacgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaagcaaacccaaggagcctgtattcagtgcagaagaaggctatgtaaaaatgtttcttcgtggacgccctgttaccatgtacatgcccaaagatcaagtggattcttacagcttggaagcaaaagtagaacttccaaccaagagactcaagctggaatgggtctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtgcctagcagttcatcctgatcggatcacgatagcaacaggacaagttgcgggcacatcgaaggatggaaaacaattgcccccacatgtgcgcatctgggattctgtgacattgaatactctccacgtcattggaataggtttttttgaccgagcagtcacctgtattgcattctcaaaatctaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggagattccagaacagtttggtccaatacggacagtggccgaggggaaaggcgatgtgatcttgattggcacaactcgaaactttgtcctgcagggcactctgtcaggggacttcacacccattactcagggtcacactgatgagctctggggactggccatccatgcctcaaaatctcagttcttgacctgtgggcatgacaagcatgccactctctgggacgctgtgggtcaccgtcccgtctgggacaaaataatagaggatccagctcagtcttctggttttcatccttcagggtctgtggttgcagtcggaacactcactgggaggtggtttgtgtttgacacagaaacaaaagacttggtcaccgttcacacagatggaaacgaacagctctctgtaatgcgatactcaccagatgggaatttcttagccataggctcacatgacaactgcatctatatatatggcgttagtgacaacgggaggaagtacacgcgagtgggcaagtgctcgggtcattccagcttcattactcacctggactggtctgtaaactcacagttcctcgtgtcaaattccggagactacgaaatcctctactgggttccctctgcctgtaagcaagtcgtaagtgtggaaactacaagagacattgaatgggctacctatacctgcactttgggattccatgtttttggagtgtggccagaaggctcggacggaaccgacatcaatgccgtctgtcgggcccatgagaagaaactcctgtcaacaggcgacgactttggcaaagtgcacctcttctcatacccctgctcgcagttcagggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacacccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttattatgaatgaatgaatgaatttgatggatttaaaaaaaaaaaaaaaaaa

SEQ ID NO: 3728 - DNA, 771 bp, Homo sapiens
tcgcaacgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagaggttctactggatccttttctggaggttttgttgttgaacagaagtagaggcgaatttgaaatttgaaaagagcaagtcaaattaatgtaaatccctgatgtggtatcaattccctcctgatttcccatgtaggaaattaaggcctaaattggagcatttgggtgtgtggggaaatgagggaaagatgttagaaactgaaatgcagactgcccccaggcatttgcctgtttgaatgttggaggttttaggattgtgcactttttaagcattagagataaattttgggatgcatcatttcagaagaagatcaaaccatctctcctacagaaataaatcctcaacttgaaatgaaaaaaaaaaaaaaaaa

SEQ ID NO: 3729 - DNA, 5484 bp, Homo sapiens
aattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttctttttttttttttttttaaagcagatggttgaaacacccatgctatctgttcctatctgcaggaactgatgtgtgcatatttagcatccctggaaatcataataaagtttccattagaacaaaagaataacattttctataacatatgatagtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctc

SEQ ID NO: 3730 - DNA, 4435 bp, Homo sapiens
ggcgatccgctggcgctagtctgaccctccgccaggcaaaaggaagattgtctttggctatagagtttttttttttaaagattactaaacatacaggaagtgataagaagtatcattcatcagaagcatcattcatcaatcaacttgaagaaaaaggtgatatattatttctttaaggtgctgtgtgatgtgttaagagcatattagaaggaatggttttgtctaattttcttcatgagttatggtggctgagacatcgagtctatattttggggcaaaaactaaacggcagcacaaaaggaaatctatattaatagaatattttgttgaacaaaggaggttagataagaactgcaaaccaacagactcagcaaacaaggaaagaaacgtgttagccataagacatgtttcaagtgaatcgaagtccaataactgtagacttcagaagaaaaaagttttcaaaaattttatcaaaacaggtcactgataaataactcctccagtaatagagctaggcctgaaaccaaaattaattaaaaaattaacaaaacagattgaacctgaattaaatttcttttgataaaaaaacttattaaaaataatcaaaattttcctcaaatttttattaccttgtccaaagtaaagcaagtgtcttttagcattcatgccagcttttctcatgttctaggaatgacagaaaccttacttgaagcaaactagtatttttgttgaaaatgtatatcagcatcagttaaagttgatttttcagacctgctcctcagtaataatactagctagtcagcattcacgcctaccaggacacaaaaatcctcttcaaaactactcagaaaagaaagtcattactcaggaatgatgtccattcaggagaaatcaaaagagaattcctccaaagttactaaaaaaagtgacgataagaattcagaaacagaaattcaggattctcaaaagaatctagcaaaaaaatcaggtccaaaggagactataaaatcacaggctaaatcttccagtgaaagtaaaataaatcagccagaattggaaacacgcatgagtacaaggtcatcaaaggcagcatctaatgataaagctactaaatccattaataaaaatacggtgactgtgaggggatattcacaagaatctacaaaaaagaaattatctcagaaaaaattagtacatgaaaaccctaaagcaaatgaacagcttaaccggagatcacaaaggctacaacaattaacagaggtttcaagaaggtcgttacgcagtagagaaattcagggtcaagttcaagcagttaaacagagtttgccaccaactaaaaaagagcagtgtagcagtactcagagtaaatctaataaaacaagtcaaaaacatgtgaagagaaaagtactggaagtaaagtctgactctaaagaagatgaaaatctagtaattaatgaagtaataaattctcccaaagggaaaaaacgcaaggtagaacatcagacagcttgtgcttgtagttctcaatgcacgcaaggatctgaaaagtgtcctcagaagactactagaagagacgaaacgaaacctgtgcctgtaacttctgaggtgaaaagatcaaaaatggctacttcagtggtcccgaaaaagaatgagatgaagaagtcggttcatacacaagtgaatactaacacaacactcccaaaaagtccacagccatcagtgcctgaacaaagtgataatgagctggagcaagcaggaaagagcaaacgaggtagtattctccagctctgtgaagaaattgctggtgaaattgagtcagataatgtagaggtaaaaaaggaatcttcacaaatggaaagtgtaaaggaagaaaagcccacagaaataaaattggaagagaccagtgttgaaagacaaatacttcatcagaaggaaacaaatcaggatgtgcaatgtaatcgttttttcccaagtagaaaaacaaagcctgtgaaatgtatactaaatggaataaacagcttagccaagaagaactccaactggactaaaattaaactctcaaaatttaactctgtgcagcacaataagttggactctcaagtttcccctaaattaggcttattacgaaccagtttttcaccaccagctttagaaatgcatcatccagtgactcaaagtacatttttagggacaaagctacatgatagaaatataacttgccagcaggaaaaaatgaaagaaattaattctgaagaagtgaaaattaatgatattacagtagaaattaataaaaccacagaaagggctcctgaaaattgtcatttggccaatgagataaaaccttctgacccaccattggataatcagatgaaacattcttttgattcagcatcaaataagaatttcagccaatgtttggaatccaagctagaaaacagtccagtggaaaatgttactgctgcttcgactctgctcagtcaagcaaaaattgatacaggagagaataaatttccaggttcagctccccaacagcatagtattctcagtaaccagacatctaaaagcagtgataacagggagacaccacgaaatcattctttgcctaagtgtaattcccatttggagataacaattccaaaggacttgaaactaaaagaagcagagaaaactgatgaaaaacagttgattatagatgcaggacaaaaaagatttggagcagtttcttgtaatgtttgtggaatgctgtatacagcttcaaatccagaagatgaaacacagcatctgcttttccacaaccagtttataagtgctgttaaatatgtgggctggaagaaagaaagaattctggctgaataccctgatggcaggataataatggttcttcctgaagacccaaagtatgccctgaaaaaggttgacgagattagagagatggttgacaatgatttaggttttcaacaggctccactaatgtgctattccagaactaaaacacttctcttcatttccaatgacaaaaaagtagttggctgcctaattgcggaacatatccaatggggctacagagttatagaagagaaacttccagttatcaggtcagaagaagaaaaagtcagatttgaaaggcaaaaagcctggtgctgctcaacattaccagagcctgcaatctgcgggatcagtcgaatatgggtattcagcatgatgcgtcggaagaaaattgcttctcgcatgattgaatgcctaaggagtaactttatatatggctcatatttgagcaaagaagaaattgctttctcagatcccactcctgatggaaagctgtttgcaacacagtactgtggcactggtcaatttctggtatataattttattaatggacagaatagcacgtaaaacaaattcttgcctacaccactagaagacatctattgaagagaatggattggttgctgactttaaccaggaactagggccatttttattacaatgaactcaggactggcaacaaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagctttttctaagtg

SEQ ID NO: 3731 - DNA, 3582 bp, Homo sapiens
gtttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcggtaagccttcggccgcggctgcccggtagtcccggcggcggcggacagacgagctgacaggcaccagggtctaaggcggctcctcagtccggctgctgtctccacgcctggggtcgggcaccgctccttctgaccttcctttccccgtttgtcccgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttgctacactgcctcgaaaagaaagtgctgtcaaacaggaaacagagagtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaagttgacatttgataatatttttaggtctatcatatgctgtcttctgtattaaagcaagttcttac

SEQ ID NO: 3732 - DNA, 3426 bp, Homo sapiens
gtttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttgctacactgcctcgaaaagaaagtgctgtcaaacaggaaacagagagtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaagttgacatttgataatatttttaggtctatcatatgctgtcttctgtattaaagcaagttcttac

SEQ ID NO: 3733 - DNA, 3381 bp, Homo sapiens
gtttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttggtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaagttgacatttgataatatttttaggtctatcatatgctgtcttctgtattaaagcaagttcttac

SEQ ID NO: 3734 - DNA, 662 bp, Homo sapiens
accgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgct

SEQ ID NO: 3735 - DNA, 10542 bp, Homo sapiens
ccgctggttccgtaacaacatcccgttggcttccctcaggcggcgggaccagtgcagccgccgcctcccaggatcgtccgccggtcagggcccttgccctccccggcacaggccaccatggccaccaacccacagccgcagccgcctcctccggcgccgccgcctcccccgccgcagccgcagccgcagccaccgccgccgccgccgggccccggggctggccccggcgcgggcggggcgggcggcgcgggtgcgggcgccggggacccgcagctcgtggccatgatcgtgaaccacctcaagagccaggggctcttcgaccagttccgcagagactgcctggccgacgtggacaccaagcctgcgtatcagaatctgagacagcgtgttgacaactttgttgcaaatcacttggcaactcacacatggagtccgcatctcaataagaaccagctaagaaacaacattagacaacaagtcctcaaatcaggaatgttggagtctggtattgaccgaattatttctcaggttgtggacccaaagatcaaccacacattcagacctcaggtagagaaagctgtgcatgagtttttggccacgctaaatcacaaagaggaaggaagtggcaacacagctcccgatgatgagaaaccagacacttcccttattacacaaggtgttcctactcctgggcccagtgctaatgtagccaatgatgccatgtcgatattggaaaccataacttctcttaaccaagaagccagtgctgctagggcttcaacagaaacatcaaatgccaagaccagtgagagagcgtcaaaaaaacttccatctcagccaaccactgatactagtactgacaaagaaagaacttcagaggacatggctgataaagaaaaatctacagctgactctggaggtgaaggactggaaacagccccaaagtctgaagagttcagcgacctcccctgtccagtcgaagaaattaaaaattacacaaaagagcataataatttaattctgctaaataaggatgttcaacaggaaagcagtgagcaaaaaaataaatcaacagacaaaggtgaaaagaagccagacagcaatgagaaaggagaaagaaagaaagaaaagaaggaaaagactgaaaagaaatttgatcactcaaaaaagagtgaagatacacagaaagttaaagatgaaaaacaagcaaaggaaaaagaagtagagagtttaaaacttccttcagaaaagaacagtaataaagctaaaactgttgaagggacaaaagaagatttctctttgatagattctgatgtggatggacttacagacatcacagttagctctgttcataccagtgacctttcatcttttgaagaagatactgaggaggaagttgtaacgtctgatagcatggaagaaggagagattacgtcagatgatgaagagaagaacaaacagaataaaacaaaaactcaaactagtgattctagtgaaggaaaaacaaaaagtgtacggcatgcgtatgtccacaaaccatatctttactcaaaatactatagtgattctgatgatgagcttactgtagaacaacgacgacagtccattgccaaagaaaaagaagagaggcttttaagaaggcaaatcaatagagaaaaacttgaagaaaaacgaaaacagaaagcagaaaagacaaagtcttcaaaaaccaagggtcaaggcaggagtagtgtggacttagaagaatcatcaacaaagagtttggaacctaaagccgccagaattaaagaagtccttaaagaacggaaagttttagaaaaaaaagtagccttaagcaaaaagagaaaaaaagattcaaggaatgttgaagagaactccaaaaagaaacagcaatatgaagaagattccaaagaaacccttaaaacaagtgagcattgtgaaaaggaaaaaatttcttcttcaaaggagctgaagcatgttcatgcaaaaagtgaaccaagtaaacctgcccggagactttcagagtctttgcatgtagttgacgaaaacaaaaatgaatccaaattagaaagagaacataaaagacggacatctacccctgttatcatggagggggtacaggaagagactgacacaagagatgtaaaaaggcaagtagaacgctcagaaatttgcaccgaagagccccagaaacagaaaagcacacttaaaaacgaaaagcatctaaagaaagatgattctgaaacaccacatttgaaaagcctacttaagaaagaggtgaaatcctccaaggagaagcctgaaagagagaaaactccatcggaagacaaattgtctgtgaaacataaatataaaggtgattgtatgcataaaacaggtgatgagactgagcttcactcttctgagaaaggtttaaaagtagaggaaaatattcaaaagcaaagtcaacaaacaaagctttcttcagatgataaaaccgaacgaaaaagtaaacataggaatgaaaggaaattatcagtattaggcaaagatggaaagccagtttctgaatatattataaaaacagatgagaatgttcgtaaagaaaacaacaaaaaagagagacgcttgtcagctgaaaaaactaaggcagagcacaaatcaagaaggtcaagtgattctaaaattcagaaagattctctgggttccaagcaacatggtatcacattacagagaagaagtgaaagttattcggaagataagtgtgatatggactccactaacatggatagtaatttgaaaccagaagaggttgttcacaaggagaaacgacgaacaaagagcttgttagaagagaaacttgtgttgaagtctaaatcaaaaactcaaggcaaacaggtaaaagttgtagaaacagaattacaagaaggtgccacaaaacaggcaaccactccaaaaccagacaaggagaagaacacagaagaaaatgactcagaaaaacagcgtaagtctaaagttgaagacaaaccttttgaagaaactggtgttgaacctgtattagagactgcttcttcttcagcacatagtacacagaaggattctagtcatagagccaagttaccattagcaaaggagaaatataagagtgataaagactccacttccaccaggcttgagagaaagttgtcagatggccacaaaagcagaagcttaaagcatagtagtaaagacataaaaaagaaggacgaaaataaatcagatgacaaggatggtaaagaagttgacagtagtcatgaaaaggccagaggtaatagttcactcatggaaaagaaattaagtagaaggttgtgcgaaaatcggagaggaagcttgtcacaagaaatggccaaaggagaagaaaaattagcagcaaacactttgagcactcccagcggttcctcccttcagagaccaaaaaagagtggtgatatgacattgatccctgaacaagagccaatggaaattgattctgagccaggtgttgaaaatgtgtttgaagtatctaaaacccaagacaaccgcaataataattctcagcaagacattgactctgaaaatatgaaacaaaaaacttctgccactgttcaaaaggatgaattgagaacttgcacagcagattcaaaagcaacagctccagcttataagccaggccgtggaacaggagttaatagtaattctgaaaagcatgccgatcatagaagcaccttgaccaagaaaatgcatatacaaagtgctgtgtccaaaatgaaccctggggagaaagaacccattcatagaggaactactgaagtgaatatagattctgaaactgttcatagaatgttactgagtgccccatcagaaaatgatagggtacagaagaatttgaaaaacacagctgctgaagaacatgttgctcaaggagatgccactcttgaacattccacaaatttagactcctcaccatccttaagttcagtgactgttgtgcctctgagggaatcgtatgatccagatgtaattcctctgtttgacaaaagaactgttttggaaggtagcacagccagcacctcccctgcggatcactctgctctccctaaccaaagtctgactgttagggaatcagaagtccttaagacaagtgacagcaaagaaggtggtgaaggtttcacagtagatacaccagcaaaagcaagcatcactagcaaaagacacattccagaagctcaccaggctactttattggatggtaaacaaggaaaggtaatcatgcctcttggaagtaagttaacgggcgtgattgtggaaaatgagaatattaccaaagaaggtggcttagtggacatggccaagaaagaaaatgacttaaatgcagagcccaatttaaagcagacaattaaagcaacagtagagaatggcaagaaggatggcattgctgttgatcatgttgtaggcctgaatacagaaaaatatgctgaaactgtcaaacttaagcataaaagaagcccaggtaaagtaaaagacatatcaattgatgttgaaagaaggaatgaaaacagtgaggtagacaccagtgctggaagtggctctgcaccctctgttttacaccaaaggaacggacaaactgaggatgtggcaactgggcctaggagagcagaaaagacttctgttgccactagtactgaagggaaggacaaagatgtcaccttaagtccagtgaaggctgggcctgccacaaccacttcttcagaaacaagacaaagtgaggtggctttgccttgcaccagcattgaggcagatgaaggcctcataataggaacacattccagaaataatcctcttcatgttggtgcagaagccagtgaatgcactgtttttgctgcagctgaagaaggtggggctgttgtcacagagggatttgctgaaagtgaaaccttcctcacaagcactaaggaaggggaaagtggggagtgtgctgtggctgaatctgaggacagagcagcagacctactggctgtgcatgcagttaaaatcgaagccaatgtaaatagcgttgtgacagaggaaaaggatgatgctgtaaccagtgcaggctctgaagaaaaatgtgatggttctttaagtagagactcagaaatagttgaaggaactattacttttattagtgaagttgaaagtgatggagcagttacaagtgctggaacagagataagagcaggatctataagcagtgaagaggtggatggctcccagggaaatatgatgagaatgggtcccaaaaaagaaacagagggcactgtgacatgtacaggagcagaaggcagaagtgataactttgtgatctgctcagtaactggagcagggccccgggaggaacgcatggttacaggtgcaggtgttgtcctgggagataatgatgcaccaccaggaacaagtgccagccaagaaggagatggttctgtgaatgatggtacagaaggtgagagtgcagtcaccagcacggggataacagaagatggagaggggccagcaagttgcacaggttcagaagatagcagcgaaggctttgctataagttctgaatcggaagaaaatggagagagtgcaatggacagcacagtggccaaagaaggcactaatgtaccattagttgctgctggtccttgtgatgatgaaggcattgtgactagcacaggcgcaaaagaggaagacgaggaaggggaggatgttgtgactagtactggaagaggaaatgaaattgggcatgcttcaacttgtacagggttaggagaagaaagtgaaggggtcttgatttgtgaaagtgcagaaggggacagtcagattggtactgtggtagagcatgtggaagctgaggctggagctgccatcatgaatgcaaatgaaaataatgttgacagcatgagtggcacagagaaaggaagtaaagacacagatatctgctccagtgcaaaagggattgtagaaagcagtgtgaccagtgcagtctcaggaaaggatgaagtgacaccagttccaggaggttgtgagggtcctatgactagtgctgcatctgatcaaagtgacagtcagctcgaaaaagttgaagataccactatttccactggcctggtcgggggtagttacgatgttcttgtatctggtgaagtcccagaatgtgaagttgctcacacatcaccaagtgaaaaagaagatgaggacatcatcacctctgtagaaaatgaagagtgtgatggtctcatggcaactacagccagtggtgatattaccaaccagaatagcttagcagggggtaaaaatcaaggcaaagttttgattatttccaccagtaccacaaatgattacacccctcaggtaagcgcaattacagatgtggaaggaggtctctcagatgctctgagaactgaagaaaatatggaaggtaccagagtaaccacagaagaatttgaggcccccatgcccagtgcagtctcaggagatgacagccaactcactgccagcagaagtgaagagaaagatgagtgtgccatgatttccacaagcataggggaagaattcgaattgcctatctccagtgcaacaaccatcaagtgtgctgaaagtcttcagccggttgctgcagcagtggaagaaagggctacaggtccagtcttgataagcaccgccgactttgaggggcctatgcccagtgcgcccccagaagctgaaagtcctcttgcctcaaccagcaaggaggagaaggatgaatgtgctctcatttccactagcatagcagaagaatgtgaggcttctgtttccggtgtagttgttgaaagtgaaaatgagcgagctggcacagtcatggaagaaaaagacgggagtggcatcatctctacgagctcggtggaagactgtgagggcccagtgtccagtgctgtccctcaagaggaaggcgacccctcagtcacaccagcggaagagatgggtgacaccgccatgatttccacaagcacctctgaagggtgtgaagcagtcatgattggtgctgtcctccaggatgaagatcggctcaccatcacaagagtagaagacttgagcgatgctgccatcatctccaccagcacagcagaatgtatgccaatttccgccagcattgacagacatgaagagaatcagctgactgcagacaacccagaagggaacggtgacctgtcagccacagaagtgagcaagcacaaggtccccatgcccagcctaattgctgagaataactgtcggtgtcctgggccagtcaggggaggcaaagaaccgggtcccgtgttggcagtgagcaccgaggaggggcacaacgggccatcagtccacaagccctctgcagggcaaggccatccaagtgctgtttgtgcggaaaaagaagagaagcatggcaaggagtgccccgaaataggaccatttgcaggaagaggacagaaagagagcactttacacctcataaatgcagaagagaagaatgtattgttgaactcccttcagaaagaagataagagcccagagacagggacagcagggggcagtagcacagcaagttattcagcaggaaggggcttagaggggaatgctaactcacctgcccacctgagaggaccagaacagacgtctgggcagacggctaaggatccctctgtcagcattcgctatttggcagcagtaaacaccggtgctataaaagctgatgacatgccacctgttcaagggaccgtggctgagcattcctttcttcctgctgagcagcaggggtctgaagacaacttgaaaaccagtaccaccaaatgtattactggccaagaatcaaaaattgctccttcccacacaatgatccctccagctacttacagtgtagctctgttggctcctaaatgtgagcaggacttgactataaagaatgattatagtggcaaatggactgatcaagcatctgctgagaaaacaggagatgataacagcacaaggaaatcattccctgaggaaggagacataatggttactgtgtcttctgaagaaaatgtgtgtgacataggcaatgaagagtctccattgaatgttttgggaggattgaaactgaaagccaacttgaaaatggaggcttatgtgccttcagaggaagagaaaaatggtgaaattctggcaccaccagaaagtctgtgtgggggaaagccaagtggaatagctgaactccagagggagcctttgttggtgaatgaatcactaaatgttgaaaattcaggcttcagaacaaatgaagaaattcatagcgaatcttataacaaaggagagatatccagtggtagaaaagacaacgcagaagccataagcggtcacagtgttgaagcagatcctaaagaggttgaagaggaagaaaggcatatgcctaaaagaaaaagaaagcagcattatctctcttcagaagatgaaccagatgataatccagatgtcctggattccagaatagaaacagcacaaaggcagtgtcctgaaacggagccacatgacacaaaggaagagaactccagagatttggaagaattacctaaaaccagttctgagacaaatagcactacctcaagggtcatggaagaaaaagatgaatatagcagcagtgaaactactggtgaaaagccagagcagaacgatgatgacaccataaaatctcaggaggaagatcagccaataattattaaaaggaaaagaggaagacctcgcaaataccctgtagaaacaacgttaaaaatgaaagacgactccaaaacagatactggcattgtcactgtagaacaatctccatctagcagcaaactgaaagtaatgcaaacagatgaatccaataaagaaacagctaacctacaagaaagaagtataagcaatgatgatggtgaagaaaaaatagtaacaagtgtgcgtcggagaggaagaaaacccaaacgttctctcactgtatcagatgatgctgaatcctcagagccagaaagaaaacgccagaaatcagtttctgatccagtggaggacaagaaagagcaggagtctgatgaggaagaggaagaagaggaagaggacgagccttcaggagccaccacaagatccaccaccagatcagaggctcagagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggtggccataggcttctctttaaccaggaaaaagatatgcatgtgctgtaagtccctaggtgcaagctttttcttgttatgttttaaacagctttataaactattgttcatagaagatattatgtacatttatttcagataaaggacaataagtttactttgtatctgaactcaaaacaaagtagttgtatattttaacattcaaaattgggatttcccaatgtgacacatcatgaatgcaaacccctccagcccatcagacgccaggctgcctactggtaatctgtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgttgacacaaaacaggttctggttcaggtaaagttgcgtcagtcacctgcagcagaaatccctcttcattcctcttctctgtgttcattcctcttctgtgctgttctgaagcttctaccaatactctttccatattgtctttttcagtgaagagaaatgcattcaagattaggtccctcctgtctatccagtttcaggattttatgttgttttatacacagttatttcagtatagaaactggctttattgccaagtgtttttttaaacatgttttaactctcatatgagcaaactgtccaacttcagtttttcataagattaaacttcttacgatcaaatttgtctcttgcaatgatgtgatgagttgccaaataattgagattattttaaaatgttttgttcatattcttgttttataattaaaatttacattcagtgtgtatgggtttttttttttattttgactcttaatgtaaggtggatatttctgtcattttacatggtttcttactgagattttatatataaattataaaatgtttacc

SEQ ID NO: 3736 - DNA, 2215 bp, Homo sapiens
agccgccacgccccgggagaggaccgaccgcccagaccgccggtcccggggccccctgggccacgccgatcacggggagcccctcgactgcctcccagaacaaagtgggaaagggaagcttagcccgccgctgccgcctccgagcagcccgccaggactctggctactggagatgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacgtgagttcctgggtggggcactatggcgcccttgtgacccactccagtgtgagggtcaggatccgtctgtcctagcgactggactactgcctgacgttgtcagtcaagaccagccttgcagccaggtgcagtggctcacacctgtggaatcccagcacttcaggaggccgaggtgggaggatcactggagctcgggagttcaagaccagcctgggcaacatagtgaaaccgtctccacaaataatttttaaaaaattagccaggcatggtggtgccgcctgtagtcccagctactcaggaggcttgggtgggaggattgcctgagaccaggaggttgaggctgcagtgagccgtgatttcaccaccactccagcctgggtgagaaagcaagaccctatatcaatgaaaaaaaaaaaaaaaaagaccagctttgcagccagaagccagaggatacccagggacagtagggctcccaggtggctggttctcagcacaccttccatgaatctgcttgctgctgcttcagtgtggtggccatcatgctgtgtgacaaaccaggctgttcacagcttcctcagccccccagaaggggagtgtcaggaagagacatttagttcatttgcctgcaaattttcttctcctgcaaggatctcggtggactcagtcacaaaacaaaggctaaaccaggatttataagagagggcttataaatccctctgccgacgcagggagcagagacttgccggcatgttttgggggtaatgatcgtgggcagggagcagaggtccgctgaggcagtctgtccttgagactaacaaagtcatctgctgtttggggaaatctctggtgttgggaacaggcccccaaatctggccataaactggccccaaaactggccataaacaaaatatctgcagcactgtgacatgtttgtgatggccatgacccccaccctgaaggttgtgggtttactggaacgagggcgaggaacacctggcccacccagggcggaaaaccgcttaaaggggttcctgaaccacaaaccatagcataagtgatctgtgccttaacgacatgttcctgctgcagataactagccagacccatccctttatttcagcccatccctttatttcctgtaagaaatgtttttagttaatctataatctatagaaataatgcttatcactggcttgctgtcaataaatatgtgggtaaatctctgttcaaggctctcagctctgaaggccgtgagacccctgatttcccactccacaccct

SEQ ID NO: 3737 - DNA, 2175 bp, Homo sapiens
atagaaatcactgagaatgatgctaagagcagcgggagcggccgtgagcccagagctaaaattagggagaagagaggagtcatgatctgggtcagcagatgacgcatgaagcaaggactctggctactggagatgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacgtgagttcctgggtggggcactatggcgcccttgtgacccactccagtgtgagggtcaggatccgtctgtcctagcgactggactactgcctgacgttgtcagtcaagaccagccttgcagccaggtgcagtggctcacacctgtggaatcccagcacttcaggaggccgaggtgggaggatcactggagctcgggagttcaagaccagcctgggcaacatagtgaaaccgtctccacaaataatttttaaaaaattagccaggcatggtggtgccgcctgtagtcccagctactcaggaggcttgggtgggaggattgcctgagaccaggaggttgaggctgcagtgagccgtgatttcaccaccactccagcctgggtgagaaagcaagaccctatatcaatgaaaaaaaaaaaaaaaaagaccagctttgcagccagaagccagaggatacccagggacagtagggctcccaggtggctggttctcagcacaccttccatgaatctgcttgctgctgcttcagtgtggtggccatcatgctgtgtgacaaaccaggctgttcacagcttcctcagccccccagaaggggagtgtcaggaagagacatttagttcatttgcctgcaaattttcttctcctgcaaggatctcggtggactcagtcacaaaacaaaggctaaaccaggatttataagagagggcttataaatccctctgccgacgcagggagcagagacttgccggcatgttttgggggtaatgatcgtgggcagggagcagaggtccgctgaggcagtctgtccttgagactaacaaagtcatctgctgtttggggaaatctctggtgttgggaacaggcccccaaatctggccataaactggccccaaaactggccataaacaaaatatctgcagcactgtgacatgtttgtgatggccatgacccccaccctgaaggttgtgggtttactggaacgagggcgaggaacacctggcccacccagggcggaaaaccgcttaaaggggttcctgaaccacaaaccatagcataagtgatctgtgccttaacgacatgttcctgctgcagataactagccagacccatccctttatttcagcccatccctttatttcctgtaagaaatgtttttagttaatctataatctatagaaataatgcttatcactggcttgctgtcaataaatatgtgggtaaatctctgttcaaggctctcagctctgaaggccgtgagacccctgatttcccactccacaccct

SEQ ID NO: 3738 - DNA, 2579 bp, Homo sapiens
ggcgccgggggacacgttggctgcgttttcggcgggcctcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatacatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcagggattattcacatttaaatattttcagttacaagcagtgaggtcctaaagtgttacaagagtacagtctaccccatgttaggcatatctttgattatgtctttattccttatttcacaatgtatttggtgtgtaggggaggggggagaactaaatgagttttcagctttataaattgttaaacatttagacaaacatatatgtatgtatgaatgtacataaatatttttaactcctattgaccacgagtctcacttcagtttcccagttcctttcaacctctttctgatagatttcctctttcattacttttagtaaccatgttccttgtttccttttattcttccatctgaagccccactcttaaaaagttgcactgttccagtagttataatccacttgccctaggaacaagttagcactgaattttgggtggaataattagtttctgaaggcttgccaggacccctgagcaggtaggctctagagtcgggcagtccaataacttttttgcaataatggaaacgtcctatgtgcagtccaatagggtagcaactggccaaatgaggcctactgattacttgaggtgtgccttgtataactgaatttatggtgctatttaaacaatttttttctaacgtgaaaaggataaaacataaaaaactcttgagaactataaagtgaacacctatatgcctacccctacctagattctatacttaacatcttttttactgtaatatctctattataataaatcttggtttttcacttaactggtgtaattggtgccaataaactactttttttgtagtgctatttaattttgattaaatttagatagccacgtgtctagcggctaccgtttggacagtatagctctagagcatggcttggtaacctgtttgccatggagcactagatggtccttttcactcctcaaaatgcatgcccattgccttcaggtttgccatggaaagtcaaatgatttccacttcattatgcaagtacgctatcatcttcaggtcttttgtatgtaaaatgtttctgttccagttgtagaccttgatgattgtgcagtatgaaatcgtattgtaattttcttgcatttagatgtcaacctcagaaacaggaacaatcgtcttttgaacttccagtaggcccacagttgttggttgttcctcaaaacaggttgtggctcctgttgaataagatgatccattaaaaactgaacaaggttgaggagaaatagtgcttacgttgaaaaatctttaagtctttgtccccgttctctaacttccttacgttttcgtttatttagctccatccccactatctactagaatttctcatatttaaaccaagatgggagactaggtcattaggaaaatattaccgtctacaattttcttatactttgatctgtcttttatttgattgtaagttgctgatggacagtgatcattagaaactgaattttgtataatactagttttatatgaaactagatatttattgcgctcaggttatgttccttttacctccttccttaataaagagaccacttgaaat

SEQ ID NO: 3739 - DNA, 2882 bp, Homo sapiens
agcggaggagtaggctggcgggcgcagggggcggggtgcgccctccctccccggccagggcgctcgggagcggggacccgagcctgcagccgagctccgctgccggccctggacactcggctcagccaagcatccttcctgggggccgaggaagtggggccactctgccgttccgaggacctgggaggagccctcggtaccccgggccccggggccctggggcacacacgtccagcccagcccgagcctgcgtttcctgagccgggatctggggcgagatggccgcaggcggcagtgcgcccgagccccgcgtcctcgtctgcctcggggcgctcctggccggctgggtcgccgtaggattggaggctgttgtcattggagaagttcatgagaatgttactctgcactgtggcaacatctcgggactgaggggccaggtgacctggtaccggaacaactcggagcctgtcttccttctctcgtccaactctagcctccggccagctgagcctcgcttctctctagtggatgccacctccctgcacattgaatcgctgagcctgggagatgagggaatctacacctgccaggagatcctgaatgtgactcagtggttccaagtgtggctgcaggtggccagcggcccctatcagattgaggtccacatcgtggccaccggcacactccccaacggcaccctctatgcagccaggggctcccaggtggacttcagctgcaacagcagctccaggccaccacccgtggttgaatggtggttccaggccctgaattccagcagcgagtcctttggccacaacctgacagtcaactttttctcactgttactgatatcgccaaacctccaagggaactacacctgtttagccttgaatcagctcagcaagagacatcgaaaggtgaccaccgagctcctggtctactatccccctccatcagctccccagtgctgggcacagatggcatcaggatcgttcatgttgcagcttacctgtcgctgggatgggggataccctgaccctgacttcctgtggatagaagagccaggaggtgtaatcgtggggaagtcaaagctgggggtggaaatgctgagcgagtcccagctgtcggatggcaagaagttcaagtgtgttacaagccacatagttgggccagagtcgggcgccagctgcatggtgcagatcaggggtccctcccttctctctgagcccatgaagacttgcttcactgggggcaatgtgacgcttacatgccaggtgtctggggcctacccccctgccaagatcctgtggctgaggaaccttacccagcccgaggtgatcatccagcctagcagccgccatctcattacccaggatggccagaactccaccctcactatccacaactgctcccaggacctggatgagggctactacatctgccgagctgacagccctgtaggggtgagggagatggaaatctggctgagtgtgaaagaacctttaaatatcggggggattgtgggaaccattgtgagcctccttctgctgggactggccattatctcagggcttctgttgcattatagccctgtgttctgctggaaagtaggaaacacttccaggggacaaaacatggatgatgtcatggttttggtggattcagaagaggaagaggaggaggaggaggaggaggaggaagatgctgcagtaggggaacaggagggagcacgtgagagagaggagttgccaaaagaaatacctaagcaggaccacattcacagagtgaccgccttggtgaatgggaacatagaacagatgggaaatggattccaggatcttcaagatgacagcagtgaggagcaaagtgacattgttcaagaagaagacaggccagtctgaagaagaggatggtccatggttgtcttgctctgaaagcttggagagctacattgaagacgagctcttcattcagctttgactccacctgcacccctggcgggggcttgcactaacaatgtttgggtctcagcaaaaaacaaaaccaagcacacacatctttccttccatgtattgaaaaacattggtttgatttgctctaagttttcccaatgatgtttaaaagctttgagaaggaaagctgctttggtgtctgaggtgccacttctgctgtgaatcctggctttatccaggttgatctactgtgatagatgctgatttagagggaacagaggtcagggaagcactgggtcttggtgccttttgccgctttttttttttttttttttttttttttttgagacggagtctccctctattgcccaggctggagtgcaatggcacgatcttggctcaccacaacttctgcctcccaggttcaagcgattctcctgcctcagccacggcaccttgcaaatatcagctccttggaacaggtgaagttccaggtaccaatgccaatcagaggaaggcagtttggttcaggctttggagttagaaacacctgaagttgaatctgggctctgttgcttccttctttcatgggctagagcacgactctttacctctctcttggcctcaatttcctcacctgtaaaatagatgaggaagctgctcacttattattgtctcgttctgaaagcttggaaagctacatcgaagatgagctcttcattcagctttgatttgacctgtacccctggtgggggattgcactggcaacatttgggtctcagcaaaaaaaccaagcacacacatctttccttccatttattgaaaaacatctttgtaagatccattcattgaaaaacataatccatttattgaaaaatatctttgtaagatcacctgctaaatatgaaaatctgaaaaaaaaaaaaaaaa

SEQ ID NO: 3740 - DNA, 2912 bp, Homo sapiens
ataaaccctgagatatgagggttgggcgagacatccgagcctgtttcgttccgtgttgggaccaggaataaccctgacttctgagctttcataaccccagggtcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactgatgaacaaaacagaacttctttttgacaccatagattcttctgaggccaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagccaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattgacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacgtgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaattttatctccatctcgaagtgcaagagtccagtttcatcttatggagttaaatagatcagtctgcttggaatgccctgagtttcagattccatggtttcatgaccgcttctgtcaacaatataataaaggtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgtcatcgtgtgttacatttggacctattttaataaagggcctgtctcaaaaaaaaaaaaaaaaa

SEQ ID NO: 3741 - DNA, 2104 bp, Homo sapiens
gagttgtttgccggctcccgggccgccagacgctcggagggagcccggccggctcggactgggcggccgggagggagggcgccccgggtcacgacggcgcccgcaagccgagcgcggccgggacgtgcaccatggacccaaaggcgggcggcggcggcgaggaggacgactgcgtggactcgggcgccgagaccggagggtccgactacagccacctgtcctccacgagcaatggattctccacctggcggatgccatgttgcctgttcctttactgtacacacggtgacaaagaaaagggaagatggagcctccaggttgaacatacctggccctcaggtgagctttccgttgaagaggcgcaggaccctttcctggtcagcatccacataatcgcagacccaggggagtcccagcccctgcaggaggccatcgacaacgtcctggcgtggatccaccccgacctcccgctgttccgggtgtccgagaggcgggcgtcccggcggcggcggaagccccccaagggcgctcagccagcgctggctgtggtgctgttcctgcaggaggagtacggcgaagagcagatcctgcagctgcaccgcacactgcagcagccgccctggcgccaccaccacaccgagcaggtgcacggccggttcctgccctacctgccctgcagccaggacttcttcacgctggcccctgggacgccgctttgggccatccggcccgtgcactacggcaaggaaatcgtgcgcttcaccgtctactgtcgctacgacaactatgctgacagcctcaggttctaccagctgattctccggaggaaccccagccagaagaaagcggacttctgcatcttccctattttttccaacctggatgtggacatccagttctccctgaaaagactgccctgtgaccagtgcccggtgcccaccgactcctccgtgctggagttccgagtgagggacataggcgagctcgtgcctctcctgcccaacccttgcagccccatcagcgaggggcgctggcagacggaggaccatgatgggaacaagatcctcctacaggcacaaagggtgcataagaagtttcctaaacctggcagagtacatcatgcctccgagaagaaacgtcattccactcctttgccgagcactgctgtaccaagccatacacctggcagcagccagcagtccccgctcaacagtcctcacccggggcccatccggacaggcctgcctcctgggcaccagcaggaatttgccggacgagccaacagcacccccaaccctccctggtctttccagagaagcaagtccttgttttgtttgcccacgggaggcccctccctggcctcctcagctgaaccacagtggttttcaaacacaggtgccccagggcacagggcatcagagtggaggcatggccacctcctctccatcgatgacctagagggggcccaggagacagacgtggacacaggcctgcggctgtcctcatcggacctgtctgtggtctctgcatattctgcacccagtaggttctgcagcacagtggagacacccctcccctccgaaagatgcagcagccactgggcagctcacaaggattccagggagggaccactgcccactgtcagcagggtgaccacagaggcctcctgggcttccctccctttcttcaccaaaaggtcttccagctcctcagcgacagctcgtgctgctcccccagctcccagcacctccaccctcacagactcctccccacagctcccatgcgatacccccaaagtcaagcagactgatggagacatgccaccacccccagggtcggctggccccggggataacgacatggaggaattctacatctgaatgccctctgctcttgttctcgaaacacacaaactcagagacacagactcaggccccactgcccctctggccactgagcacaccacattcttcatgatccatttcccaggagcccgtagcacatttgcctaccacccactcttagctggggggtggtatatctctagagacacagcagaaaaatactggcatttttatgcaaataaattctcaacaaacttgtc

SEQ ID NO: 3742 - DNA, 2253 bp, Homo sapiens
aaagctggccgtgcaggcgctcaggcgtgcagggtagccagtgccccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagggatggctgaaggggcaggaggaggagtccccattccaaaccccgggtttgtccatcctccatccatctcactcacaccttagcagggccagttttcatttatttcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgaagatgtcattgccctggtgagccaggtcttgccggtttatagtgtctttcacgtgtttgaggccatctgttgtgtctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctgggcaaaaaaaaaaaaaaaaaaa

SEQ ID NO: 3743 - DNA, 3976 bp, Homo sapiens
agaaggcgtgacgtggggtcgagagcgggatccgaggctggcgagttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaggtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatgctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaagttatacttgtattagcaagttttttttttttttcccccaccgcaacctccatctcccgggttcaagcaattctcctgcctcaccctcccaagtagctgggattacaggtgcccacctccacgcccagctaatttttgtatttttaatagagaccggttttgccatgttggccaggctggtctcgaactcctgacctcaggtgatctgcccaccccagcctcccaaaatgctgggattacaggcgtgagccacggcacgcagccagcaagttgtttttaaatgttaatatagaaaacagtgaaggattagctgaaaatatatgagcaggtgacattgaggtttactgaaatagccaatttgactggtgcttagactattgtgcagtaaacctaaaaggtagtggagaattgcttcctgctagcaggaagccttcatcttcttgagtacccaaaccaggcttcaggtgtcctttgaggatagccaggtttgaaatttttagtttctcaggaagagctcttctatgtggcaggggctgatagggcaaaataaaatgacaatttctttattgctacagagtatcctctataagttattaaacgagtgtaatggtataatgcccttccatcacacaacaggacaccaccccagttttgttttctgggtttcttccccctttgtaggaatcagataccttttgtagaaaaaaatggcttatgccacgtaaaggtgaatttttagaaaccaccttctaggcgtttttggaacccttactgaaatccctccccttgttacagatggcgtagaagtcacaagtctgttaattggactgttgcttctttgcctgttcctgctttctctttctgtctggatagtcaggaaaagatttaatgtttaatatttaaacaaaatatttaatgtctatacagtaaaattattcaaacttcaaaccagtattgaaagcagttggaaaccagctaatagtttcttaatctcagatttcgagatgaatgtaaactgtattcttttgaaatgtgcaagtgtttgattcatgccatttgataaacttctgccttgtagtcattgtttgatgggaccaacttgtaaagtatgagccttaaataaatctccatgctgaaaaatgtgttctaatgcaacacaaaaacatgaagtgactgcccagaggtagagttagtgtttaggtggaaagggagatgacagctttccaaagaaggacctaaaacacaccaagattgtcttctacaggaattgctgggcaggtctccgactaaaggtcttatgatgaaaaggaagaaacaagcccccaacacaaggctctgatactactggtaaatgtaggagagaattaagaatctgttaattaaaatccaaacagagcttatttcagtagtcaagttacctgacatgataattatttctgcaggataattgatgttttatgttcttttttggactttatcttcttgcaaaaatttctacaaaaattgttttcttcatccttgtggtgcttattcatctgagccgtctccacagtcccaatgcctctgctttttgttttacttttgtagcataaggtttttgcttttgctttgccttaagagttccctagggagttaccagggcttttcgttttgtgtagcttttgcagcatggatcaaacattggcttactgtgctaatgtgtgaagagaaaaaattctctaaagcaggtgagctttaatgaacaaatgtgtattttatctgagtttgagtagggtgcgttgtggattttgttttttgggtttttttttttttttgtaattatatgaagaaagtccagttctcataaatattgatcacttaaaaaacttactctttcttgaaaaggtacacatgtaaaatttaggaaaataactaaagtaggggctggaaccataagaagaatgtttatcagcacgttcatttattattttggatttggaacttggctttgtttttcaatagtgacaagaatggttcagttctaggaatgttctggaagatgctgttaattttactttaaaatgagaatctggtgttactgtattttatcgttttcaataaaacttcttaagtgttaaaaaaaaaaaaaaaaaaaaaaaataaaaaaaaaaaaaaaa

SEQ ID NO: 3744 - DNA, 4689 bp, Homo sapiens
aagcgcgctctgcggcgcggtccgctgtggaggcggcgcgaacggtcagggggcggccgatggctttgaggggccctgcgggcttggggcccggctctcgaaggccgttggacgaagcggtggcaggggccgagggccgcgaggcgccggcccttgtggcggcgggaggcgcgccagaggacgatgaagaggacgatggccgtggccggggcctgctgcgctgggacagcttctccgcctggctgcactgcgtgtgtgtggtgggcttcgacctggagctgggccaggccgtggaggtaatttatcctcagcattccaaacttactgacagagaaaaaaccaatatttgctatttgtcttttccagattcaaattcaggttgtcttggagatacccagttttgttttagatttcgacagtcttctgggaggagggtgtcgctgcattgtctcctggatcaatttgacaaagatttaccagtttacttaaagaaggatcctgcttatttttatggatatgtgtatttccgacaagttcgagataaaactctaaaaagaggctactttcagaagtccttggttttgatcagcaaactaccttatattcatttttttcacactgtgctcaaacagatagcaccagagtattttgaaaagaatgaaccttatttggaagcagcttgtaatgatgttgatcgatggcctgccccagtgccagggaaaacattacacctgccaatcatgggggtggtaatgaaggtacggattcccacatgtcatgacaagcctgggacaactcaaatagtgcagttaactcagcaggtggacacaaatatatctgttattttacctactgttcatgaggtggatattttcaggtgtttctgcccagttttccttcatagtcagatgctctgggagctggtgctgttgggggagccccttgtggttatggcgccatcaccatcggaatcatcagagactgtattggcacttgttaactgtatttctccattaaagtacttcagtgatttccgaccttatttcactattcatgatagtgaattcaaagaatatactacccgtacgcaagctccgccctcagttatattaggagtaaccaaccctttttttgctaagacactccagcactggccacacattattcgaataggagaccttaaacctacaggtgaaattcctaagcaggttaaagtgaaaaaactgaagaatctaaagactctggattccaaacctggagtttatacttcatataagccatatttaaatagagatgaagagatcataaaacaattacagaagggtgtacaacagaaacgtccttctgaggctcaaagtgttattcttcgacgctattttttggaactgacacaaagtttcatcattccattagaaagatatgtggcaagcttgatgcctttgcagaaaagtatttccccatggaagagtccacctcaattaagacagtttcttccagaagaatttatgaaaacacttgagaaaacaggacctcagctaacctctagaataaaaggcgattggattggactttaccggcatttcctaaagtctccaaattttgatggctggtttaagacccggaggaaggaaatgacccaaaaattggaggcactccatctagaagctctttgtgaagaggacttacttctctggatccagaaacacacagaagtagaaacagtagaccttgtcttgaagctgaaaaataagctgttgcaggctgatcgagagcacttacctgtgaaacctgacactatggaaaagttacggacacacatagatgccattatcttagcattgccagaggacttgcaaggcatactgctcaaaacgggcatgacatgatatttgccaagattttccagccaaaaaggattatgcatcatgaagcatactgacatttcaaccagacgcacaaaggagatctctcagtggcagcggagtggaaaattgccatgaatgctagttacagggtagaaagactgtattgtataaacagacctttttagtgcattactttttaaagtggatatctgtggtggttccactttaatactgaaacaccgaaaggcatttctatatttttaatcatgttctaaagtgctcttatgagagacttgtgggccatcagtattagtgatttcatactgcagtgctggcattgcagatatttttttaaattggtgctgctttgcccaatcatgttaaaactcagggggatataaaaataacattcacactggctatcttcttaagaacagaaagactgaactgtcctatggttagaaggaattgatgcttatgtagtgccttctgttgtcctacatgtttcacagttcagctgctagtcttgaagcttttccttagcttcattatgatacgtaattttataaggtattctgttgagtgatcattgtttaaaaaaaaagtttcttgctacccattgtgtttattaatagacatgatgggttttttttcagttgtcatatagattttcattattttcccttccattttcaaaatttaatgttaccagtttctccaaagacaagaaggcatctagtattaatgatggaagagtttattttctcttaccctttactaatttaaacattaggctgggtgtggtggctcacgcctgtaatcctagcactttgggaggccgaggtggacgggtcacttaaggtcgagagtccaagaccagcctggccaacatggtgaaaccccgtctctggtagaaatgcaaaaattggccaggcatggtggcacgcgcctgtaatcccagctacttgggaggctgggatgtgagaatcacttgaacctgggaggcggaggttgcagtgagctgagattgcacccctggactccagcttgggtgacacagtgagactgtgtctcaacaaaaataaaaaattaaataaatactaatttaaatattattaaatgtttaaactaatgaacttggctgcttttcaaagacattttaattataaatctcataatcagctatttttttaaactgaactattcttatttcaaaggcattcatgagttttttatgtgatacttatttgagtgatgataagattgatttctggcattatttgtttggtagcgttttatttttcccaacattaatgtttcttaaaacacttttcctactattgtttgacatgggaactttcgcctgagtcactgtcatggttagcttttgttgttgttgtttttgtttctgttttgtttaaacaatactaccttgccaaaaatagaagaatgtgatttggtagagtagggttgtttggtttgtgtttgaataagagtatcctacagaagccactttttttttttttgagatggagttttgctcttgttgcccaggctggagtgcaatggcgcaatctcggctgactgcaacctccacctcccgggtgcaagtgattgtcctgcctcagcctcctgagtagctgggattacaggtatgtgccatcacgcctggctaattttgtatttttggtagagatggggtttctccatgttggtcaggctggtctcaaactcccgacctcgggtgatccgcccgcctcggcctcccagggtgctgggattgcaggtgtgagccaccgcacctggccagaagccactaactaaaataggcacacatgacacagcatgtggttaatagctgtgtcttgaattatcctctaaataaccaaatttagttgtatgtatttgtaaaggatatggcttcagaagctatcttttgttctctgtcgatataactcttaagggcattcctgacccaagaaagactccttgcgtttgtaactgtggtctaatacccaaatgtgccctgttcttatggatacagtctcttgaagcatacctcaaagtcatagagagaatatggcatttgaaagaaatcgtttgccttggatcatatgagttattttgtgaaacaacagctgacttttcagaaaaggagcaactacttttatatgctaaaagtatttcataactttctgggaaaccttatttaggtataaatggtcatcttattatttttcaaaaaggtatattttaataattgtacaatttatatacagtttgtgaccagaatttgtaagttgttggtgtcatatcaaggatcttttaaattatgccactacaggatgtatcatttcaagtctattttgcacagctaaacagtagcaaaagatgccaattagcatgataatggtgtcttcatttttactgtatttaactgaaacctaacacatgttgaaaaccatatcatacctagtttatctcttaatttcaaactatgtacttgtaaaaatgatgtaaatttgcactgggaacctgggaaagagtgactgataatttttggtgcgtgatttttagatttgtcttttttttttaagaagaatttgttactatgtaaaccctgacattaaatgttttatctctaccagcatcaggaggaatcactgctttaagggtattatgtaatgcctagtgccttctatttacagtgaaaaagaggttttgcgaaggcatttatggtcattaccaaaaactaaattaaaggccttggattttaaaaaaaaaaaaaaaaaaaaaaaaaaaaaaaagaaaaaaaaaaaaaaaa

SEQ ID NO: 3745 - DNA, 1698 bp, Homo sapiens
agtacaatctgctgcccaggacctggacattgacagataaaatgaagtgggaagaatatgaagaactgcttcattatgctatagtgactccaaatattgaaccccgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcctcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtg

SEQ ID NO: 3746 - DNA, 10086 bp, Homo sapiens
atgaacataggtctcagagtcttccttgtaatagcagacagtttgcagcagaaagatggtgaaccacccatgccaacaacaggagttattcttccctcaggaaatactcttcgtgtaaagaaaatatttctcaataaaaccttgacagatgaagaagcaaaagtcataggaatgtcagtttactatcctcaagtaagaaaagcattagatagcatcctcagacatttggacaaagaagttgggagaccaatgtgtatgaccagtgtgcagatgtctaataaggagcctgaagacatgattacgggggaaagaaaacccaagattgatttgtttagaacttgtattgctgcgattccaaggttgattcctgacggtatgagcagaactgacctgattgaattgttagcaaggctcacaattcatatggatgaagaactgcgtgctctggctttcaatactctgcaggcactaatgcttgattttccagattggcgggaggatgttctttcaggatttgtttattttattgttcgtgaagtgactgatgtccatcccacacttcttgataatgccgtaaagatgttggtacaattaataaatcagtggaaacaagcagcccaaatgcataataaaaaccaggacactcagcatggtgtagctaatggagcttctcatccccctcctctggaaaggagcccatattccaatgtattccatgtggttgaaggctttgcgcttgtcattctctgtagcagtcgacctgccactaggagactagccgtcagtgtccttagagaaatacgggctttatttgcacttctggaaatacctaagggtgatgatgaattagccatagatgtgatggacaggctaagcccatccattcttgagagcttcatacatctcactggggctgatcagactactttgctctattgccctagctcgatagatttacaaactttagcagaatggaactcttctcctattagccaccagtttgatgtgattagtccatcacatatatggatatttgcacatgtgacccaaggccaagacccatggattataagtctctccagttttttaaagcaagaaaatcttcctaaacactgctctacagctgtgagctatgcttggatgtttgcatacacaagacttcagttgttgtcccctcaggtcgatataaatagccccatcaatgctaagaaagtaaataccaccacaagcagtgactcatacattggcctgtggagaaactatctgatcctttgctgcagtgcagcaacatcgtcatcttccacatctgcaggttctgtgagatgttctcctcctgagacgctggcgtctaccccagatagcggctatagcattgattctaaaattattggcatcccatccccttcatccttgtttaagcacatagttccaatgatgcgttctgagagcatggaaatcacagaatcccttgttctaggtcttggcaggaccaacccaggagcttttagggaactaatagaggaattacatcccataattaaagaagcactcgaaagaaggccagagaatatgaaacggcgcaggcgtcgagacattttacgagtacaactggtacgaatatttgaactgctggcagatgctgtcccatttacttcatcttttgttttcttcaatattttcagtgcaagtggtggccttgataatgaaacacattttctcaacaacactttattggaatatgtagatttaactagacaactcctggaagcagaaaatgaaaaagactctgacacactgaaggatatacgatgccattttagtgccttagtggcgaatattattcagaatgttccagtgcaccagagaagaagtatttttcctcaacagagccttcgtcacagtctatttatgctgttcagtcactgggcaggtccttttagcatcatgtttacgcccttggacagatacagtgatagaaatatgcaaattaatagacatcaatactgtgcgttaaaggctatgtctgctgtactgtgttgtggccctgttgcagataatgtaggactttcatcagatggctatttgtacaaatggttggataacattttggattctctggacaaaaaggttcaccagctgggctgtgaagcagttacgttgttactggagctgaaccctgatcagagcaacctgatgtactgggctgtggaccgctgctacacgggctccgggagggtggcggccggctgctttaaagccattgctaatgttttccagaacagggattatcaatgtgacacagtgatgcttctaaatctgatactgtttaaagcagctgattcttctagaagtatctatgaagttgctatgcaacttttacagattctggaaccgaagatgtttcgctatgctcacaaattggaggttcagagaacagatggagtactcagccagctgtctcctctaccacatctctattctgtttcatattatcagttgtccgaggaactagcaagggcgtatcctgagctaactctcgccatattctcagagataagccagagaatccagacagctcaccctgctgggcggcaggtgatgctgcactacctgctaccatggatgaacaacatcgagctggtggacttaaaacctctccccacagcaaggcgacatgatgaagatgaagatgattccttaaaagaccgagaacttatggtgactagtaggcgctggttacggggagaaggatggggatctccacaagccactgcaatggttttgaacaatctgatgtatatgacagcaaagtatggcgatgaactggcctggtcggaggtggagaatgtgtggaccacacttgcagatggctggcccaaaaacctgaaaataattttgcactttttgatcagcatttgtggggtgaatagcgaaccaagcctcttgccttacgtgaagaaggtcattgtatatttaggtagagataaaacaatgcagttgctagaagagctggtgagtgagcttcagctgaccgatcctgtcagttcaggggtcactcacatggataatcccccgtattatcgcatcacttccagctataaaatcccttctgtcacctcaggaactacttccagtagcaatacaatggtagctcccacagatggcaatcctgataataagcccattaaagagaatattgaagagagctatgtgcacctggacatttacagtggactaaacagtcatttgaatcggcaacatcacagactagaatcccgatacagtagcagctctggaggatcttatgaagaagaaaaaagtgattcaatgccactttattctaattggcgactgaaagtgatggagcataaccaaggagagccactgcccttcccaccagctggaggctgctggtcaccactggtggattacgtgcctgaaacgtcatcacctggattacctcttcacaggtgtaacatagcagtgatccttttgactgatctcatcattgatcatagtgtgaaggtggaatggggaagctacctccatcttcttcttcatgcaatttttatagggtttgaccactgccaccctgaggtgtatgaacattgtaaacgcctgcttctgcacttattaatagtaatgggacccaatagtaacatccgaactgttgcttctgtccttctcaggaacaaggagtttaatgagcccagggtgcttacagtcaaacaagttgcacacttagattataatttcacaggcattaacgattttatacctgattaccagccctcccctatgactgactcagggcttagctcaagttctacctcttctagtatcagcttaggaaataacagtgctgccatttcacatctgcacaccactatcctcaatgaggttgacatctcagtggagcaggatggaaaagtcaaaaccctcatggaattcattacctcaagaaaaagagggcccctttggaaccatgaggatgtttctgccaagaatcctagcataaagagtgctgaacagttaactacatttttgaaacatgtggtttctgtttttaagcagtcaagctcaggaattcatctggaacatcatcttagtgaagttgctctgcaaacagcactttcctgttcttctcgacactatgctgggagatcctttcagattttcagggccctaaagcagcctctcactgcaactacactttctgatgttctctccagacttgtagaaactgtaggggatccaggagaagatgcacagggatttgtgattgagcttcttctcacattggaatctgcaattgatactttggctgaaaccatgaagcattatgatcttctttctgccctttctcaaacctcatatcatgatcctataatgggaaacaagtatgcagctaacaggaaaagcactggacaactcaatctaagcacaagtcccattaatagtagcagttatttgggatataacagtaatgcaagaagtaactctttgagattaagtttgattggtgaccgacgaggtgaccggcggcggagtaacacactggatataatggatggacggataaaccatagcagtagtttagcaaggactagaagcctttcctctctaagagagaaaggaatgtatgacgtgcagtccactactgagcctaccaacttgatggccaccattttttggatagcagcatctttattagaatcagattatgaatatgaatacctcctggctctcaggcttctcaacaaactgcttatccatttgcctttggataaatcagagagtcgagagaagattgaaaatgtacaaagcaaattgaaatggactaattttccaggacttcagcagctcttccttaagggttttacctcagcatctacacaagaaatgaccgtgcacctcctcagtaaactcatttctgtctccaaacatacattggtggatccttcccaattgtcaggtgatatcgaatatcccaggaaatgaaaagaaaatggtttctgtgaaccatctaaaaaaataactttaacttttaaaataatgtgcaataaaattggttattgtttgcttttttttgttttgataggctttcctcttaacatcctttgcttattgcctcacttaatccagcattttgacagcccaactcagttttgcaaagaaacagctagtcgaatagcaaaggtttgtgcagaagaaaaatgcccaacacttgtcaatctggcacacatgatgagtttgtacagtacacacacgtattccagagactgttctaactggatcaatgtcgtgtgcagatacctgcatgactccttctcagatacaacatttaatcttgtgacttatcttgcagagctgttagagaaaggattgtccagtatgcagcaatcattactacagattatttatagtctattgagtcatattgacctgtctgcagccccagccaagcagtttaatctggagatcataaagattattggcaaatatgtacagagtccttactggaaggaagcccttaacatattaaagctggtggtgtcacgctctgcgagtcttgtcgtacccagtgatatccccaagacctatggaggagatacaggttctcctgaaatatccttcactaaaatttttaataatgtttctaaggagttgcctgggaagaccttagattttcattttgatatatctgagacaccaattattggaaacaaatatggtgatcagcacagtgcggctggaagaaatgggaaaccaaaagttattgctgtcactagaagtacttcctcaacttcttctggttctaattctaatgccttggttcctgttagttggaaaaggccacagttatcacagcgaagaacaagagaaaagctaatgaatgtgctttctctctgtggtccagaatctggcctcccaaagaacccatcagttgtattttcttctaatgaggatttggaagtcggtgaccaacagactagcctaatttctacaacagaagacataaatcaagaggaagaagtagctgtggaagataatagcagtgaacaacagtttggtgtttttaaggattttgactttttagatgttgaattggaagatgcagagggtgaaagtatggacaatttcaactggggagttcgcaggcgctcactggacagtattgacaaaggggacactccatccctccaggagtaccagtgctctagtagcacccccagcctgaacctcaccaatcaggaggatacagatgagtcctcggaagaagaagcggcacttacagcaagccagatactctcacgcacacagatgttaaacagtgattctgccactgatgaaacaataccagaccatcctgacttacttctccagtctgaagattccactggcagcatcacaacagaggaagtgcttcaaatcagggatgagaccccaactttggaggcttctctagataatgctaacagccggctgcctgagaacgttctcttgctgtctattaagacagagaaggcttttaaaaaaatttcatttcaggccgggcactgtggcttacctgagtgtccctttcttctctgtaatatacacacgttacactctgatctcaagaggggattaaactcacctcagttgcctcaactagattgagagctttcccatcattgacagctcattcaaccaatatctcttgagcctctaccacttgaacatgttacaacctttgaagatgaaggatcctatataattcaagaacagcaggaatctcttgtgtgtcaaggaattcttgatttagaagaaactgaaatgccagagcctctagctcctgaaagttaccccgagtcagtctgtgaagaggatgttaccttagctctgaaagagctagatgaaagatgtgaagaagaagaagcggatttctccggactgtctagtcaagatgaagaagagcaagatggttttccagaagtacagacgtcgcctctgccgtcaccatttctttctgccatcatagccgcctttcagcccgtggcatatgatgatgaagaggaagcctggcgctgccacgtcaatcagatgctgtctgacaccgacgggtcctctgcagtgtttacttttcatgtgttttctaggctgtttcagacaattcaaagaaagtttggagaaataactaatgaggcagtcagctttcttggtgatagtctgcaacgcattggtaccaaatttaaaagttccttggaagtgatgatgctgtgttcagaatgcccaacagtctttgtggatgctgaaacactgatgtcatgtggtttgctggaaacactcaagtttggtgttttggagttgcaagaacacctggatacatacaatgtgaaaagagaagccgctgagcagtggctagatgattgtaagaggacatttggtgccaaagaagacatgtataggataaacacagatgcacaagaattggagctctgccgaagattatacaaattgcattttcaattgctgcttctgttccaggcctactgtaaacttatcaaccaagtaaatacgataaaaaatgaagcagaggtcatcaacatgtcagaggaacttgcccaactggaaagtatcctcaaagaagctgagtccgcttccgaaaacgaagaaattgacatttccaaagctgcacaaactactatagaaactgccattcattctttaattgaaactttgaaaaataaagaatttatatcagctgtagcacaagtcaaagctttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcattagaaaagttttaacttattttactccatatagaaactgtagagactaaaaccagttattttcttgtacatttgtgccatgcactgttgttatacaagaataggtgtacaaagctaaagaaaaattgtggtcattgatgatggaatatatgacttgcaggctttgaagtctgcagaattcaagaaaagagctgcaaatgcatttttgtatctttattcaggactcacatgctttaccctaaagaaacctggggctaggggaaatgaaaggaagcctgaagactgactaccaaaacatgcaatatacttattcactgtctaagtctgtagtataacatgaactggagtctctatccttttctaaaatcgcattttgtaagaaaagaaagaaaaaaaaaaaaaaagaatgtagtcccacaactcctgatttgaaagaaacaccttgtattttttatatacatctcttatccactgtgacttttcttttaaactgggctctgtgattccagagtttagaatgtagaaatgaaatgcttagctttaccttttcttggggggtgtggaccctgccagaaatgtaattacgtatgctcaagtgcattaattgaaggcactgtgcacaccattggactgctgaccacagttaaacatttccagtaaaatttcgtaactggtcacagctcattcataatcactgtattttttgaccctgataaagacaattattttgatggtgttctggtactgtaattggtatcctttaaattatttaaaacttttgggtgtggggcaggcagagagggatggtgtccagagatacatcacactttacatcctatcttactgtcctctgtttttcttaccctccttacatcctttttgttaaaaataaaaagcattgtagctgttggtttgtgttgtattttaacaaagaatgaatgattacagtgtgcatcatttagaaacctttcaaatgttaccttcttgaattgccctagaaaagaacaaaattagttgactacccaaccaaacctttcagttgatatttgctttttgtgtttatttatatgtaactaagtctattaatataataaaaatgaatatacctg

SEQ ID NO: 3747 - DNA, 10086 bp, Homo sapiens
atgaacataggtctcagagtcttccttgtaatagcagacagtttgcagcagaaagatggtgaaccacccatgccaacaacaggagttattcttccctcaggaaatactcttcgtgtaaagaaaatatttctcaataaaaccttgacagatgaagaagcaaaagtcataggaatgtcagtttactatcctcaagtaagaaaagcattagatagcatcctcagacatttggacaaagaagttgggagaccaatgtgtatgaccagtgtgcagatgtctaataaggagcctgaagacatgattacgggggaaagaaaacccaagattgatttgtttagaacttgtattgctgcgattccaaggttgattcctgacggtatgagcagaactgacctgattgaattgttagcaaggctcacaattcatatggatgaagaactgcgtgctctggctttcaatactctgcaggcactaatgcttgattttccagattggcgggaggatgttctttcaggatttgtttattttattgttcgtgaagtgactgatgtccatcccacacttcttgataatgccgtaaagatgttggtacaattaataaatcagtggaaacaagcagcccaaatgcataataaaaaccaggacactcagcatggtgtagctaatggagcttctcatccccctcctctggaaaggagcccatattccaatgtattccatgtggttgaaggctttgcgcttgtcattctctgtagcagtcgacctgccactaggagactagccgtcagtgtccttagagaaatacgggctttatttgcacttctggaaatacctaagggtgatgatgaattagccatagatgtgatggacaggctaagcccatccattcttgagagcttcatacatctcactggggctgatcagactactttgctctattgccctagctcgatagatttacaaactttagcagaatggaactcttctcctattagccaccagtttgatgtgattagtccatcacatatatggatatttgcacatgtgacccaaggccaagacccatggattataagtctctccagttttttaaagcaagaaaatcttcctaaacactgctctacagctgtgagctatgcttggatgtttgcatacacaagacttcagttgttgtcccctcaggtcgatataaatagccccatcaatgctaagaaagtaaataccaccacaagcagtgactcatacattggcctgtggagaaactatctgatcctttgctgcagtgcagcaacatcgtcatcttccacatctgcaggttctgtgagatgttctcctcctgagacgctggcgtctaccccagatagcggctatagcattgattctaaaattattggcatcccatccccttcatccttgtttaagcacatagttccaatgatgcgttctgagagcatggaaatcacagaatcccttgttctaggtcttggcaggaccaacccaggagcttttagggaactaatagaggaattacatcccataattaaagaagcactcgaaagaaggccagagaatatgaaacggcgcaggcgtcgagacattttacgagtacaactggtacgaatatttgaactgctggcagatgctgtcccatttacttcatcttttgttttcttcaatattttcagtgcaagtggtggccttgataatgaaacacattttctcaacaacactttattggaatatgtagatttaactagacaactcctggaagcagaaaatgaaaaagactctgacacactgaaggatatacgatgccattttagtgccttagtggcgaatattattcagaatgttccagtgcaccagagaagaagtatttttcctcaacagagccttcgtcacagtctatttatgctgttcagtcactgggcaggtccttttagcatcatgtttacgcccttggacagatacagtgatagaaatatgcaaattaatagacatcaatactgtgcgttaaaggctatgtctgctgtactgtgttgtggccctgttgcagataatgtaggactttcatcagatggctatttgtacaaatggttggataacattttggattctctggacaaaaaggttcaccagctgggctgtgaagcagttacgttgttactggagctgaaccctgatcagagcaacctgatgtactgggctgtggaccgctgctacacgggctccgggagggtggcggccggctgctttaaagccattgctaatgttttccagaacagggattatcaatgtgacacagtgatgcttctaaatctgatactgtttaaagcagctgattcttctagaagtatctatgaagttgctatgcaacttttacagattctggaaccgaagatgtttcgctatgctcacaaattggaggttcagagaacagatggagtactcagccagctgtctcctctaccacatctctattctgtttcatattatcagttgtccgaggaactagcaagggcgtatcctgagctaactctcgccatattctcagagataagccagagaatccagacagctcaccctgctgggcggcaggtgatgctgcactacctgctaccatggatgaacaacatcgagctggtggacttaaaacctctccccacagcaaggcgacatgatgaagatgaagatgattccttaaaagaccgagaacttatggtgactagtaggcgctggttacggggagaaggatggggatctccacaagccactgcaatggttttgaacaatctgatgtatatgacagcaaagtatggcgatgaactggcctggtcggaggtggagaatgtgtggaccacacttgcagatggctggcccaaaaacctgaaaataattttgcactttttgatcagcatttgtggggtgaatagcgaaccaagcctcttgccttacgtgaagaaggtcattgtatatttaggtagagataaaacaatgcagttgctagaagagctggtgagtgagcttcagctgaccgatcctgtcagttcaggggtcactcacatggataatcccccgtattatcgcatcacttccagctataaaatcccttctgtcacctcaggaactacttccagtagcaatacaatggtagctcccacagatggcaatcctgataataagcccattaaagagaatattgaagagagctatgtgcacctggacatttacagtggactaaacagtcatttgaatcggcaacatcacagactagaatcccgatacagtagcagctctggaggatcttatgaagaagaaaaaagtgattcaatgccactttattctaattggcgactgaaagtgatggagcataaccaaggagagccactgcccttcccaccagctggaggctgctggtcaccactggtggattacgtgcctgaaacgtcatcacctggattacctcttcacaggtgtaacatagcagtgatccttttgactgatctcatcattgatcatagtgtgaaggtggaatggggaagctacctccatcttcttcttcatgcaatttttatagggtttgaccactgccaccctgaggtgtatgaacattgtaaacgcctgcttctgcacttattaatagtaatgggacccaatagtaacatccgaactgttgcttctgtccttctcaggaacaaggagtttaatgagcccagggtgcttacagtcaaacaagttgcacacttagattataatttcacaggcattaacgattttatacctgattaccagccctcccctatgactgactcagggcttagctcaagttctacctcttctagtatcagcttaggaaataacagtgctgccatttcacatctgcacaccactatcctcaatgaggttgacatctcagtggagcaggatggaaaagtcaaaaccctcatggaattcattacctcaagaaaaagagggcccctttggaaccatgaggatgtttctgccaagaatcctagcataaagagtgctgaacagttaactacatttttgaaacatgtggtttctgtttttaagcagtcaagctcaggaattcatctggaacatcatcttagtgaagttgctctgcaaacagcactttcctgttcttctcgacactatgctgggagatcctttcagattttcagggccctaaagcagcctctcactgcaactacactttctgatgttctctccagacttgtagaaactgtaggggatccaggagaagatgcacagggatttgtgattgagcttcttctcacattggaatctgcaattgatactttggctgaaaccatgaagcattatgatcttctttctgccctttctcaaacctcatatcatgatcctataatgggaaacaagtatgcagctaacaggaaaagcactggacaactcaatctaagcacaagtcccattaatagtagcagttatttgggatataacagtaatgcaagaagtaactctttgagattaagtttgattggtgaccgacgaggtgaccggcggcggagtaacacactggatataatggatggacggataaaccatagcagtagtttagcaaggactagaagcctttcctctctaagagagaaaggaatgtatgacgtgcagtccactactgagcctaccaacttgatggccaccattttttggatagcagcatctttattagaatcagattatgaatatgaatacctcctggctctcaggcttctcaacaaactgcttatccatttgcctttggataaatcagagagtcgagagaagattgaaaatgtacaaagcaaattgaaatggactaattttccaggacttcagcagctcttccttaagggttttacctcagcatctacacaagaaatgaccgtgcacctcctcagtaaactcatttctgtctccaaacatacattggtggatccttcccaattgtcaggtgatatcgaatatcccaggaaatgaaaagaaaatggtttctgtgaaccatctaaaaaaataactttaacttttaaaataatgtgcaataaaattggttattgtttgcttttttttgttttgataggctttcctcttaacatcctttgcttattgcctcacttaatccagcattttgacagcccaactcagttttgcaaagaaacagctagtcgaatagcaaaggtttgtgcagaagaaaaatgcccaacacttgtcaatctggcacacatgatgagtttgtacagtacacacacgtattccagagactgttctaactggatcaatgtcgtgtgcagatacctgcatgactccttctcagatacaacatttaatcttgtgacttatcttgcagagctgttagagaaaggattgtccagtatgcagcaatcattactacagattatttatagtctattgagtcatattgacctgtctgcagccccagccaagcagtttaatctggagatcataaagattattggcaaatatgtacagagtccttactggaaggaagcccttaacatattaaagctggtggtgtcacgctctgcgagtcttgtcgtacccagtgatatccccaagacctatggaggagatacaggttctcctgaaatatccttcactaaaatttttaataatgtttctaaggagttgcctgggaagaccttagattttcattttgatatatctgagacaccaattattggaaacaaatatggtgatcagcacagtgcggctggaagaaatgggaaaccaaaagttattgctgtcactagaagtacttcctcaacttcttctggttctaattctaatgccttggttcctgttagttggaaaaggccacagttatcacagcgaagaacaagagaaaagctaatgaatgtgctttctctctgtggtccagaatctggcctcccaaagaacccatcagttgtattttcttctaatgaggatttggaagtcggtgaccaacagactagcctaatttctacaacagaagacataaatcaagaggaagaagtagctgtggaagataatagcagtgaacaacagtttggtgtttttaaggattttgactttttagatgttgaattggaagatgcagagggtgaaagtatggacaatttcaactggggagttcgcaggcgctcactggacagtattgacaaaggggacactccatccctccaggagtaccagtgctctagtagcacccccagcctgaacctcaccaatcaggaggatacagatgagtcctcggaagaagaagcggcacttacagcaagccagatactctcacgcacacagatgttaaacagtgattctgccactgatgaaacaataccagaccatcctgacttacttctccagtctgaagattccactggcagcatcacaacagaggaagtgcttcaaatcagggatgagaccccaactttggaggcttctctagataatgctaacagccggctgcctgagaacgttctcttgctgtctattaagacagagaaggctttaaaaaaaatttcatttcaggccgggcactgtggcttacctgagtgtccctttcttctctgtaatatacacacgttacactctgatctcaagaggggattaaactcacctcagttgcctcaactagattgagagctttcccatcattgacagctcattcaaccaatatctcttgagcctctaccacttgaacatgttacaacctttgaagatgaaggatcctatataattcaagaacagcaggaatctcttgtgtgtcaaggaattcttgatttagaagaaactgaaatgccagagcctctagctcctgaaagttaccccgagtcagtctgtgaagaggatgttaccttagctctgaaagagctagatgaaagatgtgaagaagaagaagcggatttctccggactgtctagtcaagatgaagaagagcaagatggttttccagaagtacagacgtcgcctctgccgtcaccatttctttctgccatcatagccgcctttcagcccgtggcatatgatgatgaagaggaagcctggcgctgccacgtcaatcagatgctgtctgacaccgacgggtcctctgcagtgtttacttttcatgtgttttctaggctgtttcagacaattcaaagaaagtttggagaaataactaatgaggcagtcagctttcttggtgatagtctgcaacgcattggtaccaaatttaaaagttccttggaagtgatgatgctgtgttcagaatgcccaacagtctttgtggatgctgaaacactgatgtcatgtggtttgctggaaacactcaagtttggtgttttggagttgcaagaacacctggatacatacaatgtgaaaagagaagccgctgagcagtggctagatgattgtaagaggacatttggtgccaaagaagacatgtataggataaacacagatgcacaagaattggagctctgccgaagattatacaaattgcattttcaattgctgcttctgttccaggcctactgtaaacttatcaaccaagtaaatacgataaaaaatgaagcagaggtcatcaacatgtcagaggaacttgcccaactggaaagtatcctcaaagaagctgagtccgcttccgaaaacgaagaaattgacatttccaaagctgcacaaactactatagaaactgccattcattctttaattgaaactttgaaaaataaagaatttatatcagctgtagcacaagtcaaagctttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcattagaaaagttttaacttattttactccatatagaaactgtagagactaaaaccagttattttcttgtacatttgtgccatgcactgttgttatacaagaataggtgtacaaagctaaagaaaaattgtggtcattgatgatggaatatatgacttgcaggctttgaagtctgcagaattcaagaaaagagctgcaaatgcatttttgtatctttattcaggactcacatgctttaccctaaagaaacctggggctaggggaaatgaaaggaagcctgaagactgactaccaaaacatgcaatatacttattcactgtctaagtctgtagtataacatgaactggagtctctatccttttctaaaatcgcattttgtaagaaaagaaagaaaaaaaaaaaaaaagaatgtagtcccacaactcctgatttgaaagaaacaccttgtattttttatatacatctcttatccactgtgacttttcttttaaactgggctctgtgattccagagtttagaatgtagaaatgaaatgcttagctttaccttttcttggggggtgtggaccctgccagaaatgtaattacgtatgctcaagtgcattaattgaaggcactgtgcacaccattggactgctgaccacagttaaacatttccagtaaaatttcgtaactggtcacagctcattcataatcactgtattttttgaccctgataaagacaattattttgatggtgttctggtactgtaattggtatcctttaaattatttaaaacttttgggtgtggggcaggcagagagggatggtgtccagagatacatcacactttacatcctatcttactgtcctctgtttttcttaccctccttacatcctttttgttaaaaataaaaagcattgtagctgttggtttgtgttgtattttaacaaagaatgaatgattacagtgtgcatcatttagaaacctttcaaatgttaccttcttgaattgccctagaaaagaacaaaattagttgactacccaaccaaacctttcagttgatatttgctttttgtgtttatttatatgtaactaagtctattaatataataaaaatgaatatacctg

SEQ ID NO: 3748 - DNA, 2819 bp, Homo sapiens
gctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagccccaaaaaaaaaaaaaaaaaaaaaaaaaaaaaaaaaaaaaaaaaaa

SEQ ID NO: 3749 - DNA, 2650 bp, Homo sapiens
gccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 3750 - DNA, 2561 bp, Homo sapiens
tacccagcctgtcgctaaactttccgggcgccagcccggctctgagtcgcgcttctcagcggagtgacccagggacggaggacccaggctggctggggactgtctgctcttctcggcgggatccgtggagagtcctttccctggaatccgagccctaaccgtctctccccagccctatccggcgaggagcggagcgctgccagcggaggcagcgccttcccgaagcagtttatctttggacggttttctttaaaggaaaaagcaaccaacaggttgccagccccggcgccacacacgagacgccggagggagaagccccggcccggattcctctgcctgtgtgcgtccctcgcgggctgctggaggcgaggggagggagggggcgatggctcggcctgacccatccgcgccgccctcgctgttgctgctgctcctggcgcagctggtgggccgggcggccgccgcgtccaaggccccggtgtgccaggaaatcacggtgcccatgtgccgcggcatcggctacaacctgacgcacatgcccaaccagttcaaccacgacacgcaggacgaggcgggcctggaggtgcaccagttctggccgctggtggagatccaatgctcgccggacctgcgcttcttcctatgctctatgtacacgcccatctgtctgcccgactaccacaagccgctgccgccctgccgctcggtgtgcgagcgcgccaaggccggctgctcgccgctgatgcgccagtacggcttcgcctggcccgagcgcatgagctgcgaccgcctcccggtgctgggccgcgacgccgaggtcctctgcatggattacaaccgcagcgaggccaccacggcgccccccaggcctttcccagccaagcccacccttccaggcccgccaggggcgccggcctcggggggcgaatgccccgctgggggcccgttcgtgtgcaagtgtcgcgagcccttcgtgcccattctgaaggagtcacacccgctctacaacaaggtgcggacgggccaggtgcccaactgcgcggtaccctgctaccagccgtccttcagtgccgacgagcgcacgttcgccaccttctggataggcctgtggtcggtgctgtgcttcatctccacgtccaccacagtggccaccttcctcatcgacatggaacgcttccgctatcctgagcgccccatcatcttcctgtcagcctgctacctgtgcgtgtcgctgggcttcctggtgcgtctggtcgtgggccatgccagcgtggcctgcagccgcgagcacaaccacatccactacgagaccacgggccctgcactgtgcaccatcgtcttcctcctggtctacttcttcggcatggccagctccatctggtgggtcatcctgtcgctcacctggttcctggccgccggcatgaagtggggcaacgaggccatcgcgggctacgcgcagtacttccacctggctgcgtggctcatccccagcgtcaagtccatcacggcactggcgctgagctccgtggacggggacccagtggccggcatctgctacgtgggcaaccagaacctgaactcgctgcgcggcttcgtgctgggcccgctggtgctctacctgctggtgggcacgctcttcctgctggcgggcttcgtgtcgctcttccgcatccgcagcgtcatcaagcagggcggcaccaagacggacaagctggagaagctcatgatccgcatcggcatcttcacgctgctctacacggtccccgccagcattgtggtggcctgctacctgtacgagcagcactaccgcgagagctgggaggcggcgctcacctgcgcctgcccgggccacgacaccggccagccgcgcgccaagcccgagtactgggtgctcatgctcaagtacttcatgtgcctggtggtgggcatcacgtcgggcgtctggatctggtcgggcaagacggtggagtcgtggcggcgtttcaccagccgctgctgctgccgcccgcggcgcggccacaagagcgggggcgccatggccgcaggggactaccccgaggcgagcgccgcgctcacaggcaggaccgggccgccgggccccgccgccacctaccacaagcaggtgtccctgtcgcacgtgtaggaggctgccgccgagggactcggccggagagctgaggggaggggggcgttttgtttggtagttttgccaaggtcacttccgtttaccttcatggtgctgttgccccctcccgcggcgacttggagagagggaagaggggcgttttcgaggaagaacctgtcccaggtcttctccaaggggcccagctcacgtgtattctattttgcgtttcttactgccttctttatgggaaccctctttttaatttatatgtatttttcttaatttgtaactttgttgcattttggcaacaatttacctttgctttgggggctttacaatcctaaggttggcgttgtaatgaagttccacttggttcaggtttctttgaactgtgtggtctcaattgggaaaatatatttcctatacgtgtgtcttt

SEQ ID NO: 3751 - DNA, 1558 bp, Homo sapiens
cggaggagagcgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttga

SEQ ID NO: 3752 - DNA, 2370 bp, Homo sapiens
agtctctccttgtaccctccccctgcctcgatgatattactcccccagacttggaagccgctgccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattat

SEQ ID NO: 3753 - DNA, 2308 bp, Homo sapiens
agtctctccttgtaccctccccctgcctcgatgatattactcccccagacttggaagccgctgccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatgcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattat

SEQ ID NO: 3754 - DNA, 3871 bp, Homo sapiens
agtctctccttgtaccctccccctgcctcgatgatattactcccccagacttggaagccgctgccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgcattctaa

SEQ ID NO: 3755 - DNA, 3488 bp, Homo sapiens
gcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgtttacatatgaaattgcaccagtgtttgtcctcatggaacaaataacacttaagaagatgagagagatagttggatggtcaagtaaagatggtgatgggatattttctcctgggggcgccatatccaacatgtacagcatcatggctgctcgctacaagtacttcccggaagttaagacaaagggcatggcggctgtgcctaaactggtcctcttcacctcagaacagagtcactattccataaagaaagctggggctgcacttggctttggaactgacaatgtgattttgataaagtgcaatgaaagggggaaaataattccagctgattttgaggcaaaaattcttgaagccaaacagaagggatatgttcccttttatgtcaatgcaactgctggcacgactgtttatggagcttttgatccgatacaagagattgcagatatatgtgagaaatataacctttggttgcatgtcgatgctgcctggggaggtgggctgctcatgtccaggaagcaccgccataaactcaacggcatagaaagggccaactcagtcacctggaaccctcacaagatgatgggcgtgctgttgcagtgctctgccattctcgtcaaggaaaagggtatactccaaggatgcaaccagatgtgtgcaggatacctcttccagccagacaagcagtatgatgtctcctacgacaccggggacaaggcaattcagtgtggccgccacgtggatatcttcaagttctggctgatgtggaaagcaaagggcacagtgggatttgaaaaccagatcaacaaatgcctggaactggctgaatacctctatgccaagattaaaaacagagaagaatttgagatggttttcaatggcgagcctgagcacacaaacgtctgtttttggtatattccacaaagcctcaggggtgtgccagacagccctcaacgacgggaaaagctacacaaggtggctccaaaaatcaaagccctgatgatggagtcaggtacgaccatggttggctaccagccccaaggggacaaggccaacttcttccggatggtcatctccaacccagccgctacccagtctgacattgacttcctcattgaggagatagaaagactgggccaggatctgtaatcatccttcgcagaacatgagtttatgggaatgccttttccctctggcactccagaacaaacctctatatgttgctgaaacacacaggccatttcattgagggaaaacataatatcttgaagaatattgttaaaaccttacttaaagcttgtttgttctagttagcaggaaatagtgttctttttaaaaagttgcacattaggaacagagtatatatgtacagttatacatacctctctctatatatacatgtatagtgagtgtggcttagtaatagatcacggcatgtttcccgctccaagagaattcactttaccttcagcagttaccgaggagctaaacatgctgccaaccagcttgtccaacaactccaggaaaactgtttttcaaaacgccatgtcctaggggccaagggaaatgctgttggtgagaatcgacctcactgtcagcgtttctccacctgaagtgatgatggatgagaaaaaacaccaccaaatgacaagtcacaccctccccattagtatcctgttaggggaaaatagtagcagagtcattgttacaggtgtactatggctgtatttttagagattaatttgtgtagattgtgtaaattcctgttgtctgaccttggtggtgggagggggagactatgtgtcatgatttcaatgattgtttaattgtaggtcaatgaaatatttgcttatttatattcagagatgtaccatgttaaagaggcgtcttgtattttcttcccatttgtaatgtatcttatttatatatgaagtaagttctgaaaactgtttatggtattttcgtgcatttgtgagccaaagagaaaagattaaaattagtgagatttgtatttatattagagtgcccttaaaataatgatttaagcattttactgtctgtaagagaattctaagattgtacataaagtcatatatatggaaatcctgttacttaaatagcatctgctcttctcttacgctctctgtctggctgtacgtctggtgttctcaatgcttttctagcaactgttggataataactagatctcctgtaattttgtagtagttgatgaccaatctctgtgactcgcttagctgaaacctaaggcaacatttccgaagaccttctgaagatctcagataaagtgaccaggctcacaactgtttttgaagaagggaaattcacactgtgcgttttagagtatgcaagaagaatataaataaataaaaatattctccatggagaatttgaacaaaaaaaaaaaaaaaa

SEQ ID NO: 3756 - DNA, 1272 bp, Homo sapiens
gcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtggcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgccatcagacatgagggagtgttggttgctacggtgatggggctcagagcagaaccaaagcatgattgtgacctccagaggtgatggtaactgcacacatggtttccaagggtcttcctcctaaatttccaggggcctcccaaggaaaatggacatattctttttggaaataaaatacttctaccaacataaaaaaaaaaaaaaaaaa

SEQ ID NO: 3757 - DNA, 1086 bp, Homo sapiens
ccccggcccacaagcccctgcagggagcgggcccgggcggcgcgcgatcgaggtcgggtcgccgtccagcctgcagcatgagcgcccccagcgcgacccccatcttcgcgcccggcgagaactgcagccccgcgtggggggcggcgcccgcggcctacgacgcagcggacacgcacctgcgcatcctgggcaagccggtgatggagcgctgggagaccccctatatgcacgcgctggccgccgccgcctcctccaaagggggccgggtcctggaggtgggctttggcatggccatcgcagcgtcaaaggtgcaggaggcgcccattgatgagcattggatcatcgagtgcaatgacggcgtcttccagcggctccgggactgggccccacggcagacacacaaggtcatccccttgaaaggcctgtgggaggatgtggcacccaccctgcctgacggtcactttgatgggatcctgtacgacacgtacccactctcggaggagacctggcacacacaccagttcaacttcatcaagaaccacgcctttcgcctgctgaagccggggggcgtcctcacctactgcaacctcacctcctggggggagctgatgaagtccaagtactcagacatcaccatcatgtttgaggagacgcaggtgcccgcgctgctggaggccggcttccggagggagaacatccgtacggaggtgatggcgctggtcccaccggccgactgccgctactacgccttcccacagatgatcacgcccctggtgaccaaaggctgagcccccaccccggcccggccacacccatgccctcctccgtgccttcctggccgggagtccagggtgtcgcaccagccctgggctgatcccagctgtgtgtcaccagaagctttcccggcttctctgtgaggggtcccaccagcccagggctgatcccagctgtgtgtcaccagcagctttcccagcttctctgtgagggtcactgctgcccactgcagggtccctgaggtgaagtaaacgccggcgctgggcttggccagtcggcagtgaaaaaaaaaaaaaaaaaaaaaaaaaaaaa

SEQ ID NO: 3758 - DNA, 960 bp, Homo sapiens
ccccggcccacaagcccctgcagggagcgggcccgggcggcgcgcgatcgaggtcgggtcgccgtccagcctgcagcatgagcgcccccagcgcgacccccatcttcgcgcccggcgagaactgcagccccgcgtggggggcggcgcccgcggcctacgacgcagcggacacgcacctgcgcatcctgggcaagccggtgatggagcgctgggagaccccctatatgcacgcgctggccgccgccgcctcctccaaagggggccgggtcctggaggtgggctttggcatggccatcgcagcgtcaaaggtgcaggaggcgcccattgatgagcattggatcatcgagtgcaatgacggcgtcttccagcggctccgggactgggccccacggcagacacacaaggtcatccccttgaaaggcctgtgggaggatgtggcacccaccctgcctgacggtcactttgatgggatcctgtacgacacgtacccactctcggaggagacctggcacacacaccagttcaacttcatcaagaaccacgcctttcgcctgctgaagccggggggcgtcctcacctactgcaacctcacctcctggggggagctgatgaagtccaagtactcagacatcaccatcatgtttgaggtgcgcccacctgaagttccccatgggtctccaggaagtgaccttggatgggggtgggaaggggctgctggagccaccttgctacctggggagggtcccttcctgaccccctgggtgggctggactgtgctggttcatttagaaatcaaagtcctttgcctggcgcagtggctgccaggagcagtggctcaggtctataatcccagcactgtggaaggccgaggtgggcagattgcttgagcctaggagttcaagaccagcctgggctacagagcaagacctcatctttcctaaaaaaaaaaaatacaaaaaa

SEQ ID NO: 3759 - DNA, 2649 bp, Homo sapiens
ctgggacgcagctgcccccgctcggcgcccgctgcacccttagcagccactgccacctgggcccggagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatctcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaaccctgctcattgttgttctctcctggctttccttctggatcaacccggacgcgagtgctgccagagtgcccctgggtatcttctcagtcctcagcttggcctctgagtgcacaacccttgccgctgagcttcccaaagtttcctatgtgaaggctcttgatgtttggcttattgcttgccttctctttgggtttgcttccctggtggagtatgcagttgtccaggtgatgctgaacaaccccaaaagggttgaagctgaaaaagccagaattgctaaggctgagcaagcagatggaaaaggtggaaatgtggctaaaaagaatactgtgaatggaacagggactcctgttcatattagcactttgcaggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtcaccattctaatgtatgtagtatttcaaatttccttccttgtaactttcaaagaaagccatcttattcttgtaattttagatggtattatcacagatttaaaaaggttgtattacatattgtttaaactttgtaagtagaaatatatctgttataattatacaggctctgtggagaaataaagttcaaaatatattaatttgtaaaatcagctcgttttaaagtgtgcttgtgttgtcaaaaatatcagatagtaatacacagtgagcatttttaaacaaagggaaacctatatttatgtaactgtatactgaattctgacaaaataaaaaaagataccttattgacgaaatatttaggataaacaaaattctatttaatccaccttaaaacctaaatgtattttcatggatttcatttgttggtacatattacacaaaacattgtgccttaaaatgagtcatacatcttttaaattggaatgcagtaatagatatgtgattttacatcatttttaagaaaccaaggggaagtaataagttgaaaaagaaatccataactattaaaagattttaacttttttattttattaaaatgcttgcatattttaagtaaaattaaaaaaaaaaaaaaaaaaaaaaaaaaaaaaaaaaaaaaaaaaaaaaa

SEQ ID NO: 3760 - DNA, 2636 bp, Homo sapiens
cacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgtgtgagcagcaacattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatcaaaaaaaaaaaaaa

SEQ ID NO: 3761 - DNA, 2506 bp, Homo sapiens
cacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatcaaaaaaaaaaaaaa

SEQ ID NO: 3762 - DNA, 2470 bp, Homo sapiens
gaattcggcacgagccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgaaggagctcaaaaagtgggatgagtttgaagatattttagaagagaggaggcatgtcagtgacttgaaatttgcaatgaaatgctacacacctcttgtctataagggaattactccatgtaaaccaattgatattaaatgtagtgttctcaattctgaggagattcattatgtcattaaacagctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaactacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagagtctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgaaaaaaaaaaaaaaaaaactcgag

SEQ ID NO: 3763 - DNA, 3080 bp, Homo sapiens
gggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttataaaa

SEQ ID NO: 3764 - DNA, 3047 bp, Homo sapiens
cacccgaaggcgtccgggaatcttcactttttccgttgctagcagtggaagggtcacagaccaaacactaaggcctgagcggtgacaaccgaggcgagatgatggtcaacagggaatgcctcgtgggagaaaaaagacaattttattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttataaaa

SEQ ID NO: 3765 - DNA, 2075 bp, Homo sapiens
gccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggt

SEQ ID NO: 3766 - DNA, 1669 bp, Homo sapiens
gagcaagatggctgactccaaagagggtgttttgccgctgacggctgcttccactgccccaatttcattcggcttcactcgcacgtccgcacggaggcggctggccgactcgggagacggcgcggggccatctccggaggagaaggatttcttgaaaaccgtggaagggagggagctgcagagtgtgaagccccaggaggcccccaaggaactcgtcatccctttgatccagaatggccatcgcaggcagccaccagcccggccccctgggccatccacagatactggggccttggcggatggggtggtgtcccaggctgtgaaggagctcattgcggaatccaagaagtctctggaagagagagagaatgcgggtgtcgaccccacgctcgctatccccatgatccagaaaggatgcacccccagcggggaaggggcagacagcgaaccccgggcagagacagtgccagaggaggctaattatgaggcggtccccgtggaggcctatgggctggccatgctgcggggcatgggctggaaacctggcgagggcatcggccgcaccttcaatcaagtagtgaagccccgtgtcaactcactgaggcccaaggggttagggctgggtgccaacctgaccgaggcccaggccttgacccccactggcccctcccgcatgccaagaccagatgaggagcaagagaaagataaggaagatcagcctcaagggctggtgcctggaggagctgtggtggttctttctggccctcaccgaggcctctatgggaaggtggaaggccttgatcctgacaatgttcgggccatggttcgtctggctgtggggagccgggtggtgactgttagtgagtactacctgcggcctgtctcccagcaggagtttgacaagaacaccttggatctcaggcaacagaacggaactgcctcatcacggaagaccctctggaatcaagaactctacatccagcaggacaactcagagaggaagcggaaacaccttccagaccgacaggatgggcctgcagccaagagtgagaaagcagcccccagaagtcagcactggttgcacagggacctgcgtgtgcggtttgtggacaacatgtacaaaggaggccaatattacaacaccaagatgataattgaagatgtcctaagcccagatacctgtgtatgtcggacagatgaaggccgagtcctggaaggcctgagggaagacatgctggagaccctggttcccaaggcagagggtgaccgtgtgatggtggtgctgggcccacagactggaagggtgggacatttgctgagccgggacagagcacggagccgggctttggtgcaactgccaagagaaaatcaggtggtggagcttcactacgatgccatctgccagtacatgggccctagtgacacagatgatgactgacccatgggactcctcccatcccccaggctggtaccagttctgtaccatatgagaaagttgccttcagaaggtgggaagatcattgttccatcctctacttctggtgcagtcctgggacaaggacaagggaaagggatgggtgaaccagtagggaagctagaaacaaacccaatatttaccaaaatttagggtataataaaaaccatttcaagtaaaaaaaaaaaaaaaaaa

SEQ ID NO: 3767 - DNA, 5680 bp, Homo sapiens
gggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctacaaaaaaaaaaaaaaaaaaaaaaaaaaaaaaa

SEQ ID NO: 3768 - DNA, 1645 bp, Homo sapiens
ggtgcaaatccggccgcgatgaacgcgagcgccgcctcgctcaacgactcccaggtggtggtagtggcggccgaaggagcggcggcggcggccacagcagcaggggggccggacacgggcgaatggggaccccctgctgcggcggctctaggagccggcggcggagctaatgggtctctggagctgtcctcgcagctgtcggctgggccaccgggactcctgctgccagcggtgaatccgtgggacgtgctcctgtgcgtgtcggggacagtgatcgctggagaaaacgcgctggtggtggcgctcatcgcgtccactccggcgctgcgcacgcccatgttcgtgctggtaggcagcctggccaccgctgacctgttggcgggctgtggcctcatcttgcactttgtgttccagtacttggtgccctcggagactgtgagtctgctcacggtgggcttcctcgtggcctccttcgccgcctctgtcagcagcctgctggccattacggtggaccgctacctgtccctgtataacgcgctcacctattactcgcgccggaccctgttgggcgtgcacctcctgcttgccgccacttggaccgtgtccctaggcctggggctgctgcccgtgctgggctggaactgcctggcagagcgcgccgcctgcagcgtggtgcgcccgctggcgcgcagccacgtggctctgctctccgccgccttcttcatggtcttcggcatcatgctgcacctgtacgtgcgcatctgccaggtggtctggcgccacgcgcaccagatcgcgctgcagcagcactgcctggcgccaccccatctcgctgccaccagaaagggtgtgggtacactggctgtggtgctgggcactttcggcgccagctggctgcccttcgccatctattgcgtggtgggcagccatgaggacccggcggtctacacttacgccaccctgctgcccgccacctacaactccatgatcaatcccatcatctatgccttccgcaaccaggagatccagcgcgccctgtggctcctgctctgtggctgtttccagtccaaagtgccctttcgttccaggtctcccagcgaggtctgaagggctcgccccgtgtcctctcaccaacaccacaccccaacaagccagcctttggtaagctcggtgcctgctgacgaactctgagatcccaatggtgtgagtctgactttggaaagaaaaagggactaaagagaaatgtaacaaacttacaaggacaaagaggcttgttggcactttacatatacagtgtatacatgtgtacatatatatacaaatatttgtatcttctggaggtgttcaggatgtggagcttcctattctgtgaaaaaccaagaaaaagatatggttgtatactcaaattgtacatcacgtttgtcaaacgaagacattccaatactgcttaattatagcactttatttttagctgctgaactgccaaaacagtgttgccattttcaagggcagggaaaagggagtaaaaggtgtatttttgtcgtatgtgatagaatattttgctgcacatgcatcaacaaattacaacatgttttgtacacgaataaacccattacaagaatgtaaaaaaaaaaaaaaaaaaaaa

SEQ ID NO: 3769 - DNA, 1448 bp, Homo sapiens
ccgggagggttgggccagaggaggcggtcctggtagggagtgcgtagcagggtggagtcgctgtccggtcgcgcttcacttctgctccgccctccctgctccccataacagacccctccctccactaaggcttccaaacgtcgccccaagcctcccaatttctcgcagcccttcatgctcttctcttggccctagcaggagtggtcaccagcagtccctgtcccttggcaccaggagtccctgtagcctggctaggtaaggaaagggagttgcatctccaaataaggaagatccagttgtggccacccaattcctcctcttcgaaagacactttctgcccatcacctgctttctgtgccaggaccatctttactttctccacaaaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacaccacggggaaggctgtgtgccttttctcatccgcttttgttgtgtgtgactccaaagaatgcccgcgctgaaatttggcgtgaattaaactgaagcccaggcctctaaaaaaaaaaaaaaaaaaaaaaaa

SEQ ID NO: 3770 - DNA, 1231 bp, Homo sapiens
gccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacaccacggggaaggctgtgtgccttttctcatccgcttttgttgtgtgtgactccaaagaatgcccgcgctgaaatttggcgtgaattaaactgaagcccaggcctctaaaaaaaaaaaaaaaaaaaaa

SEQ ID NO: 3771 - DNA, 1145 bp, Homo sapiens
gccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacaagacggtgcccatcaatctcataaaggatgggggccaacagttttctaaggacttccaggcactgaatcctatgaagcaggtgccaaccctgaagattgatggaatcaccattcaccagtcaaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacaccacggggaaggctgtgtgccttttctcatccgcttttgttgtgtgtgactccaaagaatgcccgcgctgaaatttggcgtgaattaaactgaagcccaggcctctaaaaaaaaaaaaaaaaaaaaaaaaaaaaaaaaaaaaaaaaaaaaaaaaaaaaaaaaaaaaa

SEQ ID NO: 3772 - DNA, 1408 bp, Homo sapiens
cgggaacgccgctcttcgcctctcagcggcggcttgtcctttgttccggacgcccgctcctcagccctgcgtcctggggtcgctgctgcatcccgcacgcctccaccggctgcagacccatggccgagcgcggggaactcgacttgaccggcgccaaacagaacacaggagtgtggctagtcaaggttcctaaatatttgtcacagcaatgggctaaagcctctggaagaggtgaagttgggaaactgcggattgccaagactcaaggaaggactgaggtgtcatttactttgaatgaggatcttgcaaatattcatgatattggtggaaaaccagcttcagtcagtgctcctagagaacatccatttgtcttgcaaagtgttggaggacagacattaacagtatttactgagagctcatcagataagctgtcattggaaggaatagtggtacaaagagctgaatgccgaccagctgccagtgaaaactacatgcgattaaaaagattgcaaatagaagagtcttccaaaccagtgaggctatcacaacagctggacaaagttgtaacaaccaattacaaacctgttgctaatcatcaatacaatatcgaatatgaaaggaaaaagaaagaagacggaaagcgagctcgagctgataaacaacatgttttagacatgctattttcagcctttgagaaacatcaatactataatcttaaggacttggtggacatcacaaaacaacctgtggtgtacctgaaggaaatcttaaaagaaattggtgttcagaatgtaaaagggatccacaaaaacacatgggagctgaagccagagtacagacactatcaaggagaagaaaagagtgactaagaagactcctagccagcatgctagtgaaaggctagcagcgatgctatgcaaaaggcgctgatactggaaggcttgaacaccgtatgtttaataggggttaagtgacagtactttgatttctctcggtaaattttttaaacctgtaaggcttgtaaagtttcttaactgtttttttgaggagaaagaacagatttatttatagacttaacttgtattaaaccagattattcacagtaggaataggggttggaggattaagagggtttttcttaaatattagcttttaatgtgtacaattaggaaatttttttaagtgaggactctctacccttgccgtatctaaggagctgaggtaatacagatccaaggagaattgtatagcaagaaaaaaacagtcaactacagaaactcttaaaaggaataaaaacccaaagttccttattttgaaattgtcaaagaacaaacggtgtttttcttttaaacaggtgatcacgtttcttttcatactcaacgttaataaaaggagagagtttgtagtg

SEQ ID NO: 3773 - DNA, 1893 bp, Homo sapiens
cccgaaatcagactgctgccttggaccgggacagctcgcggcccccgagagctctagccgtcgaggagctgcctggggacgtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcggggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtaaagcaaacagaacccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgaccccagtctgcccactgaggggctagggctggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccatcccca

SEQ ID NO: 3774 - DNA, 4682 bp, Homo sapiens
cttacggcagtctcgcgggatttccccctctcgcgggaattatttgaacgttcgagcggtaaatactccctggggctgtcatagaagactactcggagagcgctgcctctgggttggcgggctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagatgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaatcagaacaaacctgatgtctttctgaagattttctgctgtgcgcttccacgttactttggcctgtattaaagcagtagagcagcatcagttattatagtccagaaaaagtgtgcatcagtcagtcacacagatttatcacaatctgaggtgggcctaggaatctcatttttaaatagtctctccaagtgattcttatgaactctttatgtttaaaatcatgtcattatggaaaacttacaagtgtaactagctagtagcttgcatttgagaagcttatgacttagatgggcagaatcaacaaagatgaaaccgcctgaggacacatttaacaagtaacatttctagggaaaatgaaggaagtaccacaaactggctagaaaggagcttatcaatcaccagtgaggaagaccagtataacgttcaacaacagttattttgacaaaaacttattttgtgattcctacagtgaaaacatttttggtgatatctgcctgggaaatctctcttcctaaagtatttgtatatgggagtccttgtttgtgaatgtttcctggattagggaggtgtcaacataaatgtattattaaccatgaagctgctcgctatatttttggcataacaaaataatatttatttactgtggataataattctagtgggaatataatgtgacaggaacttctctttatatacgctaccaatttatgagcactattcactgtcaatttcatttcttgtcttttgaaattgacacttggcctgacttacgaaacttgtactatatgaaattggtcctcttttctgcaatacccaacgaaacaccttttctctttattattcagaaatgtcctaacatggatctgtttgttttaataattgtgctttttttaggcttatcatctactagaggccatttacttaaggtgaaattttaagatggagctaaagtaagatcactggtttttagaaccaaattgctatacatatgtgcctcatagaacttataaaaggagtcaaagtttcaaagcaagatagttattaagcaaaaggaaaaatggtaatgatagaaagtcagttaaaaatagatgattgttcttcattctgtttgttggctctgtgttctcctgtgcttcagattccttatgtgttgttgttttaaagacaatttgcagggggttgggagaaggactgaaaaggtacattaagtgtgctgtaaggaaaagtcttagaaacataataagctaaaatcccattcacacatggccaggctatccaaaaagaaaggagccatgttctcatgtggtttaccataccaaagcttgctttctctggcatgggaaaaataaatttaagcaccaaaaaaaaaaaaaaaagaaaa

SEQ ID NO: 3775 - DNA, 8974 bp, Homo sapiens
cggacgcccggcgagtggcggaaagcgagaccccggcgccgagtgaggtcggccaggctgctgccgacttccccgctggcccctttgttcccctcccggggccctgccggcggcggttcccggttgcccgcgccagagcctcaggccggctccttttgcccttgagaagggttcgctgccaggccttcgagttccgggcgcagctcccgggagagccggcgccctgcctggcccggcggcctcctctcgggcacgaaggcttgctgctgcttctccagaacttcccttcctcgtagacacagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagctgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatggtagaatttctttgtgagagaggtgcagatgttaatagaggtcaaaggtcatcatcattacattatgctgcatgttttggaagacctcaagtagcaaagactctgttacggcatggtgcaaatccagatctgagagatgaagatgggaaaactccattagataaagctcgagaaaggggccatagtgaagtggtagctattcttcagtctccaggtgattggatgtgtccagttaataaaggagatgataagaaaaaaaaagatacaaacaaagatgaagaagaatgtaatgagcccaaaggagatccggaaatggcacccatatacttgaaaaggttattgccagtgtttgcacaaacatttcagcaaactatgctgccttcaataaggaaagcaagtcttgctctaattcgaaaaatgattcatttttgctctgaagcactgttacaagaagtttgtgattctgatgttggtcacaatttgcctacaatactagtggaaatcactgcaactgtccttgatcaagaggatgatgatgatggccacttgctagctttgcagatcataagggatatagtagataaaggtggtgatatatacaagcatcagctagccagacttggtgtaataagcaaagtgtcaacgttggcaggtccttcctctgatgatgagaatgaagaggaatcaaaaccagaaaaagaagatgaaccacaggaagatgctcaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggttcagaatttgtgactggctggactggcaaaagaggcagaaaactgaaatctaagttagaaaaaacaaagcaaaaggtacgaactatggctcgagatttatacgatgaccattttaaagctgttgaaagcatgcctcgtggagtagtggtgacactcagaaacatagcaactcagttagagtcatcttgggaacttcatacaaatagacaatgtattgaaagtgagaacacttggagagatttaatgaagacagctttaaaaaacctaattgtacttttgaaggatgaaaacacaatttcaccatatgaaatgtgtagcagtggcttggtacaagcacttcttactgtgttaaacaatgtaagtatatttagggctacaaagcaaaaacagaatgaagtcccaaaggtgattttaagtgttttcaagactgcattcactgaaaatgaagatgacgaaagtcgaccagcagttgcgttaattcgaaagttaatagctgtactagaatctattgaacgtctacctctccatttgtatgatacaccaggatccacatataacctccagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggctggattgatgtcacctgggatgctggtggctcaaactcttaccgtatgggcgcagaaggaaaatttgacctcaagcttgcaccagggtacgaccctgatacagtggcatcacccaaacctgtttcatccactgtttcaggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctatatatagttgcaagtgacccttattcaagaatatcccaggaagatggtgatgaacagcttcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgt

SEQ ID NO: 3776 - DNA, 1190 bp, Homo sapiens
cagatccatcaggtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatgaccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcctctgcctgtgcacggccagctgcatctactcaggccccaaggggtttctgtttctattctctcctcagactgctcaagagaagcacatgaaaaccattacctgactttagagcttttttacataattaaacatgatcctgagtt

SEQ ID NO: 3777 - DNA, 1182 bp, Homo sapiens
tagttctccctgagtgagacttgcctgcttctctggcccctggtcctgtcctgttctccagcatggtgtgtctgaagctccctggaggctcctgcatgacagcgctgacagtgacactgatggtgctgagctccccactggctttggctggggacacccgaccacgtttcttgtggcagcttaagtttgaatgtcatttcttcaatgggacggagcgggtgcggttgctggaaagatgcatctataaccaagaggagtccgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttggtgagagcttcacagtgcagcggcgagttgagcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagattggaccttccagaccctggtgatgctggaaacagttcctcggagtggagaggtttacacctgccaagtggagcacccaagtgtgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggattcctgagctgaaatgcagatgaccacattcaaggaagaaccttctgtcccagctttgcagaatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgtttctcaaagatggagtt

SEQ ID NO: 3778 - DNA, 1158 bp, Homo sapiens
gcctgctgctctggcccctggtcctgtcctcttctccagcatggtgtgtctgaagctccctggaggctccagcttggcagcgttgacagtgacactgatggtgctgagctcccgactggctttcgctggggacacccgaccacgtttcttggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacttgccaagtggagcacccaagcgtaacgagcgctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttctgccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagtt

SEQ ID NO: 3779 - DNA, 1193 bp, Homo sapiens
ggggggccatagttctccctgattgagacttgcctgctgctgtgaccactggtcttgtcctcttctccagcatggtgtgtctgaagctccctggaggctcctgtatggcagcgctgacagtgacattgacggtgctgagctccccactggctttggctggggacacccaaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgagtccaacctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcatccaagcatgatgagccctctcacggtgcaatggagtgcacggtctgaatctgcacagagcaagatgctgagtggagtcgggggctttgtgctgggcctgctcttccttgggacagggctgttcatctacttcaggaatcagaaaggacactctggacttcagccaacaggactcttgagctgaagtgcagatgaccacattcaaggaagaaccttctgccccagctttgcaagatgaaaagctttcccacttggctcttattcttccacaagagctttgtcaggaccaggttgttactggttcagcaactctgcagaaaatgtcctcccttgtggcttccttagctcctgttcttggcctgaagcctcacagctttgatggcagtgcctcatcttcaacttttgtgcttccctttacctaaactgtcctgcctcccgtgcatctgtactccccttgtgccacacattgcattattaaatgtttctcaaacatggagttaaaaaa

SEQ ID NO: 3780 - DNA, 3381 bp, Homo sapiens
gcggccgcagcgcgcatttgggctccgaggaagttgaccgaggcggctgccgcaggatcccgggcccggatcgcacgaagcccgcgcggccgtctcctccgcgcgccacccctgcgcctcccgcgagctccacttcccatctgctattgtttccgattgttttccggtggcgagcccggctccgaaacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgccgcgcgcttccccctcctcggccaccttcccggcggaagcagcgaggagggagccccctttggccgtcctccgtggaaccggttttccgaggctggcaaaagccgaggctggatttgggggaggaatattagactcggaggagtctgcgcgcttttctcctccccgcgcctcccggtcgccgcgggttcaccgctcagtccccgcgctcgctccgcaccccacccacttcctgtgctcgcccggggggcgtgtgccgtgcggctgccggagttcggggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaaaagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaacttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttcaaaaaaa

SEQ ID NO: 3781 - DNA, 2319 bp, Homo sapiens
gcctccacagatatcaaaagaaacctgaagagcctacaaaaaaaaaagagataaagacaaaattcaagaaaacacacacatacataattgtggtcacctggagcctgggggccggcccagctctctcaggattcagcagacattggaggtggcagtgaaggatacagtggtagtcaatgttatttgagcagggtcagcaggccctggagcttcctgagtgcacaatgcagaaggctgcttactatgaaaacccaggactgtttggaggctatggctacagcaaaactacggacacttacggctacagcaccccccaccagccctacccaccccctgctgctgccagctccctggacactgactatccaggttctgcctgctccatccagagctctgcccctctgagagccccagcccacaaaggagctgaactcaatggcagctgcatgcggccgggcactgggaacagccagggtgggggtggtggcagccagcctcctggtctgaactcagagcagcagccaccacaaccccctcctccaccaccgaccctgcccccatcttcacccaccaatcctggaggtggagtgcctgccaagaagcccaaaggtgggcccaatgcttctagctcctcagccaccatcagcaagcagatcttcccctggatgaaagagtctcgacagaactccaagcagaagaacagctgtgccactgcaggagagagctgcgaggacaagagcccgccaggcccagcatccaagcgggtacgcacggcatacacgagcgcgcagctggtggaattggaaaaggaattccacttcaaccgctacttgtgccggccgcgccgcgtggagatggccaacctgctgaatctcacggaacgccagatcaagatctggttccagaaccggcgcatgaagtacaagaaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacttgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtagcggccgccgccagcccgaactcgcggcaaaattacctctcttgctgtagtggtggggtagagggtggggcccgcggggcagttcgggaacccccttccccgctcttgccctgccgccgcctcccgggtctcaggcctccagcggcggaggcgcaggcgaccgggcctcccctccatgggcgtcctttgggtgactcgccataaatcagccgcaaggatccttccctgtaaatttgacagtgccacatactgcggaccaagggactccaatctggtaatggtgtcccaaaggtaagtctgagacccatcagcggcgcgccctgcagagggaccagagcttggagagtcttgggcctggcccgcgtctagcttagtttcagagaccttaatttatattctccttcctgtgccgtaaggattgcatcggactaaactatctgtatttattatttgaagcgagtcatttcgttccctgattatttatccttgtctgaatgtatttatgtgtatatttgtagatttatccagccgagcttaggaattcgcttccaggccgtgggggccacatttcacctccttagtccccctggtctgaactagttgagagagtagttttgaacagtcgtaaccgtggctggtgtttgtagttgacataaaggattaagaccgcaaattgtccttcatgggtagagtcaggaagcccggtggcgtggcacaacacactttggtcatttctcaaaaaccacagtcctcaccacagtttattgatttcaaattgtctggtactattggaacaaatatttagaataaaaaaatttcccagtcaaaaaaaaaaaaaaaaaaaa

SEQ ID NO: 3782 - DNA, 1041 bp, Homo sapiens
atgctattcaaacagcaggcgtggctgagacagaagctcctggtgctgggaagccttgccgttgggagtctcctgtatctagtcgccagagttgggagcttggataggctacaacccatttgccccattgaaggtcgactgggtggagcccgcactcaggctgaattcccacttcgcgccctgcagtttaagcgtggcctgctgcacgagttccggaagggcaacgcttccaaggagcaggttcgcctccatgacctggtccagcagctccccaaggccattatcattggggtgaggaaaggaggcacaagggccctgcttgaaatgctgaacctacatccggcagtagtcaaagcctctcaagaaatccacttttttgataatgatgagaattatggtaagggcattgagtggtataggaaaaagatgcctttttcctaccctcagcaaatcacaattgaaaagagcccagcatattttatcacagaggaggttccagaaaggatttacaaaatgaactcatccatcaagttgttgatcattgtcagggagccaaccacaagagctatttctgattatactcaggtgctagaggggaaggagaggaagaacaaaacttattacaagtttgagaagctggccatagaccctaatacatgcgaagtgaacacaaaatacaaagcagtaagaaccagcatctacaccaaacatctggaaaggtggttgaaatactttccaattgagcaatttcatgtcgtcgatggagatcgcctcatcacggaacctctgccagaacttcagctcgtggagaagttcctaaatctgcctccaaggataagtcaatacaatttatacttcaatgctaccagagggttttactgcttgcggtttaatattatctttaataagtgcctggcgggcagcaaggggcgcattcatccagaggtggacccctctgtcattactaaattgcgcaaattctttcatccttttaatcaaaaattttaccagatcactgggaggacattgaactggccctaa

SEQ ID NO: 3783 - DNA, 1919 bp, Homo sapiens
cgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggataaaagttgatgtgtgattttttattaaacaaatagtaaacccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcactgctctgttgccaaaactcagaatagaacttagacgtatgtctgagtccctgagatcacatgctaaagtcgatgaaaagtaaccactgccactgtcttgtgtcagaacttttacagtacagaaaataacagaatagccttctgtaatgaggcgtttgttagagttttgcatgagattctaatacttcagtaggaccctacctacgtggttcatctacaatggttaccataaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacactattttacttaaactgtttcttatctaaattcttgcagagtgtcaatgttatcattgattatagaagacagggataatacctttatctctggccactcaaaaatgcagtgccaggagtgctaaacctagaggccaatactgatgacctggaaggtgatccatatgattgtcaccacaaagtgcttttacacaaaaacttgaaaatttgaaaaacatgatttttttaagtttctcatctcaccagtcttggtgtttatattgcaaatctatcaaagtaagaaataatttgtgctgtatacaaattacatggggaacataaaggagtgagatccttctgtgataaaatgaattcaccactctggttacccaactacagaacctcctttgatcaggccagtaggttgtgatgcaggctggagcccccgaatgccccacacacactgcagcattgaccagaccatccgaaacctgcgtccctggtgatgttctcaagcctcggaagtggcaaatggaaatgatatggccggttgcggttgtaggagagttgtgacttaggcaggagtcgacctcctcaagtaatggaacgatttcaaaggcaggctgccctgaccaaaaatatctgccatgaataaaggtgcctgaaatcctaaaaaaaaaaaagaaaaaaaaaaaaaaa

SEQ ID NO: 3784 - DNA, 1795 bp, Homo sapiens
cgctgaggtgcgaaaactgggccaggggcagggctttgaccagctacttgagcgtgaaggggcggcgcccgcacgaaggggcgtcccagcttggaggcggggcccggatgggaggggcggggccgagtgcagtatcccgccagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctccttcactgccgcctttgtcatctcctttggagggtgcatgggggacgggaggaggggcacgggtttaagggacttggggagccactggaagaataataaaagtgttgctctttaaaaaaaaaaaaaaaaaa

SEQ ID NO: 3785 - DNA, 2855 bp, Homo sapiens
ctaaatccagaatcgtttcaattactgtgaggggaattctgaagttctcattaaacacacgaatgtctcaagctttgaaaagagccagatgccaaaggcaagaatcccagggcattgcccacctgggtgtgatcccctgataattgtctaacaaattcagcatgtgtcccctgggcatgaccatctgctgggaaaagttccaggaccctgagacatcttgggattcctgtggtttaggaaagacctttaactaccagctggtagttgtctcagcattcttcaaatagtccggtcttgtttaatattattattattattgttatttaattttattttattgcaactgtacttagagaatagtctggtcttgagaccttttcactgtggtctgttctggtgtacggctcccaccagtgtgaagcagaaggatgactttgctctgttgtcaggacaaccttgaaggaaggagccaaatgtgtggaggtctgtgggaagagagagccacctagcatgtccccactgaaccagtcagcagaaggccttccccaggaggcctccaacagatccctgaatgccacagaaacctcagaggcttgggatcccaggaccctccaggcgctcaagatctcccttgccgtggtcctttccgtcatcacactggccacagtcctctccaatgcctttgtactcaccaccatcttactcaccaggaagctccacacccctgccaactacctgattggctccctggccaccaccgacctcttggtttccatcttggtaatgcccatcagcatcgcctataccatcacccacacctggaactttggccaaatcttgtgtgacatctggctgtcctctgacatcacgtgctgcacagcctccatcctgcatctctgtgtcattgctctggacaggtactgggcaatcacagatgccctggaatacagtaaacgcaggacggctggccacgcggccaccatgatcgccattgtctgggccatctccatctgcatctccatccccccgctcttctggcggcaggccaaggcccaggaggagatgtcggactgtctggtgaacacctctcagatttcctacaccatctactccacctgtggggccttctacattccctcggtgttgctcatcatcctatatggccggatctaccgggctgcccggaaccgcatcctgaatccaccctcactctatgggaagcgcttcaccacggcccacctcatcacaggctctgccgggtcctcgctctgctcgctcaactccagcctccatgaggggcactcgcactcggctggctcccctctctttttcaaccacgtgaaaatcaagcttgctgacagtgccctggaacgcaagaggatttctgctgctcgagaaaggaaagccactaaaatcctgggcatcattctgggggcctttatcatctgctggctgcccttcttcgtggtgtctctggtcctccccatctgccgggactcctgctggatccacccggcgctctttgacttcttcacctggctaggctatttaaactccctcatcaatccaataatctacactgtgtttaatgaagagtttcggcaagcttttcagaaaattgtccctttccggaaggcctcctagtcttattcggtgatgactcttgttatcttttgtgtcctgtaacctcatcgggattgtcttttttttttaattattttctgagacttggattaattcatggtatcttgagtcttggttcaatcaacagaattgttctttttcctgttgttttcttaacttctgaaagagctgtgggtggtggggggcggggggcaggactgaagatttcactacttagcataatattttctttctttttttttttttttgagacggagtcttgccctctcgccaggctggagtgtagtggcacaatctcagctcactgcaacctccgcatcccgggttcaagagattctgcctcagcctccagagtagctgggactacaaacgtgtgtcaccaggcccagctaatttttgtatttttaataaagacggggtttcatcatgttggccagggtggtctcgatctcttgacctcgtgatccgcccgcctcagcatcccaaagtgctgggattacaggcatgagccactgtgcctggccaacataatgttttcacagttcctctttgttggaagaagtgtgtgacctacaagattcctggttgatacagttcaggtgagaaactgtttgattatagaaaagaccccagactcagagggaaggctctctggtctacctgagatctatatggagcttaaaggagggtgaataagattaatgacctgaattgaaagagaatttggagccaggatgggtctccattctgtgtggcaccttgattggaaaataatatccatgcgtttcttccactgagtctttcttagattaaatctctcccagttgtccgtgaagagaaagacagtatttgcagtgccgatgatatagagtgacttggagagagattcagaagttaggggtagcgggggtaggatggttgggaccagattgactaccctgtacccttccttcttccccaatatgcctgcgccatcttcacattctgaagttgaaacccatgatcacccctttgaggtagattgaccggctttagacgcccaccccccacccaccgcaagctttgagtgggacaccattctgaattttttttctgaatttttttttaacatctctttctcattagagatctgaaaactcattagagatgttgagtcttatcaaataaaaagcatgagacatcatggccaaaaaaaaaaaaaaaaaaaaaaa

SEQ ID NO: 3786 - DNA, 2260 bp, Homo sapiens
gggggtatttgtttcactgctttcaaccgcctgtgctggaggctcagaataagtcaatgggaggaggatttcagtcacagcagcaagcaagtctagtgaacagataagatgacatgctcagcaaaataacaacgaaaccagagggggaactctctggcatgcaagttcaaacacgactctacaactacggcagaaaaagagagagagagaaactaaaaatatatatatatcctatttttttcacagctatcagtttctttcactgagctttcctaaatttaagcctctagaaaataataaatacttggatatcttacctacaaacatggacagatgtgtgtatgcgctcattttagagaacttgaatttttttttttaaaggaaggtgtcaactttggcttttgagtgtttggcatggttacaatgccttaaaaaaacagatgagcagcttagctactaaccatgctgaccactgttcggaacgggattgaatcacagaaaaacagcaaatggctctctcttacagagtgtctgaacttcaaagcacaattcctgagcacattttgcagagcacctttgttcacgttatctcttctaactggtctggattacagacagaatcaataccagaggaaatgaaacagattgttgaggaacagggaaataaactgcactgggcagctcttctgatactcatggtgataatacccacaattggtggaaatacccttgttattctggctgtttcactggagaagaagctgcagtatgctactaattactttctaatgtccttggcggtggctgatttgctggttggattgtttgtgatgccaattgccctcttgacaataatgtttgaggctatgtggcccctcccacttgttctatgtcctgcctggttatttcttgacgttctcttttcaaccgcatccatcatgcatctctgtgccatttcagtggatcgttacatagccatcaaaaagccaatccaggccaatcaatataactcacgggctacagcattcatcaagattacagtggtgtggttaatttcaataggcattgccattccagtccctattaaagggatagagactgatgtggacaacccaaacaatatcacttgtgtgctgacaaaggaacgttttggcgatttcatgctctttggctcactggctgccttcttcacacctcttgcaattatgattgtcacctactttctcactatccatgctttacagaagaaggcttacttagtcaaaaacaagccacctcaacgcctaacatggttgactgtgtctacagttttccaaagggatgaaacaccttgctcgtcaccggaaaaggtggcaatgctggatggttctcgaaaggacaaggctctgcccaactcaggtgatgaaacacttatgcgaagaacatccacaattgggaaaaagtcagtgcagaccatttccaacgaacagagagcctcaaaggtcctagggattgtgtttttcctctttttgcttatgtggtgtcccttctttattacaaatataactttagttttatgtgattcctgtaaccaaactactctccaaatgctcctggagatatttgtgtggataggctatgtttcctcaggagtgaatcctttggtctacaccctcttcaataagacatttcgggatgcatttggccgatatatcacctgcaattaccgggccacaaagtcagtaaaaactctcagaaaacgctccagtaagatctacttccggaatccaatggcagagaactctaagtttttcaagaaacatggaattcgaaatgggattaaccctgccatgtaccagagtccaatgaggctccgaagttcaaccattcagtcttcatcaatcattctactagatacgcttctcctcactgaaaatgaaggtgacaaaactgaagagcgagttagttatgtatagcagaactggcagttgtcatcaaacataatgatgagtaagatgatgaatgagatgtaaatgtgccaagaatatattatataaagaattttatgtcatatatcaaatcatctctttaacctaagatgtaagtattaagaatatctaattttcctaatttggacaagattattccatgaggaaaataattttatatagctacaaatgaaaacaatccagcactctggttaaattttaaggtattcgaatgaaataaagtcaaatcaataaatttcaggccaaaaaaaaaaaaaaaaaaaaaaaaaaaa

SEQ ID NO: 3787 - DNA, 4775 bp, Homo sapiens
acccgcgcgaggtaggcgctctggtgcttgcggaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtgggttatcagctaacacccgcgagcatctataacataggccaactgacgccatccttcaaaaacaactaaaggatgatatgatgaacctagcctgttaatttcgtcttctcaattttaaactttggttgcttaagactgaagcaatcatggtgaacctgaggaatgcggtgcattcattccttgtgcacctaattggcctattggtttggcaatgtgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatgattatgtctggccactacctagatatttgtgccccgtctggatttctttagatgttttattttcaacagcgtccatcatgcacctctgcgctatatcgctggatcggtatgtagcaatacgtaatcctattgagcatagccgtttcaattcgcggactaaggccatcatgaagattgctattgtttgggcaatttctataggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtgagaaagaacagcacagtcttttcctacggtacaagctacatatgtaggaaaattttcttctttaatttttctgttggtcttaactaatgtaaatattgctgtctgaaaaagtgtttttacatatagctttgcaaccttgtactttacaatcatgcctacattagtgagatttagggttctatatttactgtttataataggtggagactaacttattttgattgtttgatgaataaaatgtttatttttgctctccctcccttctttccttccttttttcctttcttccttcctttctctctttcttttgtgcatatggcaacgttcatgttcatctcaggtggcatttgcaggtgaccagaatgaggcacatgacagtggttatatttcaaccacacctaaattaacaaattcagtggacatttgttctgggttaacagtaaatatacactttacattcttgctctgctcatctacacatataaacacagtaagataggttctgctttctgatacatctgtcagtgagtcagaggcagaacctagtcttgttgttcatataggggcaaaaatttgacattgtcagaatgttgtgttggtatttactgcaatgtctgtccctaaacatagtggtattttaacatagcagctggttaaccgggactacagaagtggaaggataatgagatgtaatacaccaaatagcttttcacttcttaaggacagtgttcaaattctgattattacaacaagcaaactgaaattagtgttttcattctggtccttagtaaattcctaattctatgattaaactgggaaatgagatcccagagttatttcccaacccaggattcaacatcaattgggttttgatctcagcatcctggaaatttgtgtgcttcacacaaagtgaaattagtattttgagccttattaaaatattttcttaattatggtacctctgtctataggacttaatttagcagtccatttttgagtaaaacttgtattggaagtatagatggtagaaactttggaagttttacttgattaaggactacagaattgggcccttagaatgtgaaaaaaaaaagtaattaaaaagacacttttaccgaactcgggattacagaaacacggagtttccatttggattttaaacaaaatttatgtcattttcagatccttccaaactctctagtgcaggaaaaggctgcagctaatttgtgaaagtggcaagctcttcattgcactgcagttatttaccagaagtttaaatctttgttaaaatatagtgttgtgttacaataagtgttggccatcatttcattcgtgggcctgctgctctctaagaattcagtagcattttaatagtttctaaaccatgaaaagttttcaagcattgctaaagtcaggccattcagtctatgctgtgtgcagagtatacaagtgtttctagtaacagtatttccatacgtgcccatttcacacaactgtggataaattttggaagaattcatgatgctagttcttacgcttgacagttacttacacacctgagaatgtgcctctcagtatcttaaaattggttaatgaaaaatctgaatttctaaaacccttggtctgtgttctcaacacacagtatagataaatccaatagtctgccacaagggcagtggaagagctgctgtatttgaggaaactcatacagtctctatttgatttgcaacactggccaaacatcagtcatttgcttgagcatgcccaaatattacatgaaagtcaagtctacctgccttgcctgttaggtctgttgaagtgcatgttaaaataattatatgaagcagaatgagatgatttaattcttaccgaaatgaaaatggctgaagaaacacagcatgcatttagcatgagttctgcacatacagatggtgtcctgcatgtatgccatgtatgttgcatgaatccatcgatttgtattaatgtagggcagaatagctgatagaagaaggactgaagaaaatccttcagcaatccttaaaaagaccatgcattcagatctgaagtagtgtgagtgttagaaaaaactggaaacatctgatttctgaactatcagggcaagctcatagcacatgttttacaaagaaacaaaatataaatcacagatttccaaaagtactagcaataagttgaatgataatagctcacagcacatttgttaatgattcttgtgtcatcaagtagtagtacttaatagtacccaacctggtaattatcctcaagttgtgtgctattcgtaagttctgtgcagtttggtatgaaacaaatatactcatttggatataaatcttacccttcaatgttaaatctacaaacttttataaatgttttaaagaagtccatgtgataattgtaaaggtgatgaatttaccatcaaacaaatcattttgatgtattattatatatgtatatctgtgtaagacacgtgcaacagactgccttatattattttctgtaattcttctcctttgtcaaatggtattttttgtgaatggttgcaaagtgttgtcttattcctaattcctgtatgttatccactacaggttttatgagacttcctattaatttattaaatttattaaatgttgaaaaaaaaaaaaaaaaaaaaaaa

SEQ ID NO: 3788 - DNA, 808 bp, Homo sapiens
tgctcccttgggctctagagaggaggcccctcttagccctcagcccctccttcctctctatcttaaagtaatttgatcctcaggaatttgttccgccctcatctggcccggccaaatcccgatttgacaaatgccaggaaaaggaaactgttgagaaaccgaaactactggggaaagggagggctcactgagtaaccatcccagtaacccgaccgccgctggtcttcgctggacaccatgagtcacactgtccaaaccttcttctctcctgtcaacagtggccagccccccaactatgagatgctcaaggaggagcacgaggtggctgtgctgggggggccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttctggtgctgctg

SEQ ID NO: 3789 - DNA, 3052 bp, Homo sapiens
actggcggcggcagggctggcggcttaggccgcagaggtctgtgggcctgagccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctaccacatgttcgtggtgatggaggacttggtggagaagctgaagctgctccgctacgaggaggagttcctccggaagagcaacctgaaggccccgtccagacactattttgcactgcctaccaaccctggcgaacagttctacatgttttgtactcttgctgcttggttgattaataaagcgggacgtccctttgagcagcctcaagaatatgatgaccctaatgcaacaatatctaacatactatccgagcttcggtcatttggaagaactgcagattttcctccttcaaaattaaagtcaggttatggagaacatgtatgctatgttcttgattgcttcgctgaagaagcattgaaatatattggtttcacctggaaaaggccaatatacccagtagaagaattagaagaagaaagcgttgcagaagatgatgcagaattaacattaaataaagtggatgaagaatttgtggaagaagagacagataatgaagaaaactttattgatctcaacgttttaaaggcccagacatatcacttggatatgaacgagactgccaaacaagaagatattttggaatccacaacagatgctgcagaatggagcctagaagtggaacgtgtactaccgcaactgaaagtcacgattaggactgacaataaggattggagaatccatgttgaccaaatgcaccagcacagaagtggaattgaatctgctctaaaggagaccaagggatttttggacaaactccataatgaaattactaggactttggaaaagatcagcagccgagaaaagtacatcaacaatcagcttgagaatttggttcaagaatatcgtgcagctcaagcccagctgagtgaggcaaaggagcgataccagcagggaaatggaggagtgacggaaagaaccagactcctctctgaggttatggaagaattagaaaaggtaaaacaagaaatggaagaaaagggcagcagcatgactgatggtgctcctttggtgaagattaaacagagcttaacaaaactgaagcaagaaactgtagagatggacattagaattggcattgtggaacacacactactccaatcaaagctgaaggagaagtccaacatgactaggaacatgcatgccacagttattccagaaccagcaacaggcttttattaaaacatactggttttcatgtttctgattagttgggttttttatatcaaactatatttcatgttgcatagatttcaaaacataattttatgttcaatgggtatttttttacatatacatactcacatattatatcatggtgattatgatggttaaagcctttacactgaatgtaatgtttaataaagaaattacaaattctcactttctaagaagctttcactaatcattacctatgttaaagctcccacctggtggctcatttttcatagcattccttgtgtaagccaaggtatatgacctgcgttttctgcagatgctgctgctgtcacaacatgaactgctgacacagtcctttaccttgctccacctctgcagtgatcataagtgctttgtgcccagaggccactgaagatggtaggcaggattctttccaagaacccaaactgcctttgcctcagctttatggttacctaaaattgccactttttttaggttaaaaaaaacttcagtatcctcattaacatttgaagttggtttcttatgaatatttcgtggctaaaatgattttatagggaatctatcttctaggatctaagccactaaataaaaggataaatgaatgatgataagtcagtcactcatgtttgactctgttcttagaatgaagagaaggtgcatatgcatgtctcaatttctacctttttctgtggtatcggctatactagggaaccattttgtagaagaaggaacgatgacaggtcgcatgaagatcagcctctagtactgatgatctttacttatgcatcttcctgagcaactttctaggctaggatttctaaattggtgaaaaaagcagcattagagtgccagaattagcactggggaaaactggccaggggaacacaaagcaggagacagcctgcgttaatttttttttttaataattttcaaaagcagtggtagaaaatttgataagaatgctttatgtttaggacaacaaaaataattttaaaaagttattttttaccctaatacttttctccactgaatattattatttttttcttagctttttctttctagatgtattccccaacatgctcacatacacagatctttccctttccttactagacctctctttagtttaagataagtttagacaggagaaagtgtatgtaaactacctgaaaggatgacaatcaatacaatgacaaatatgccagtttatttaatttgtttaaaaaaaaaaaggcagaaaacccaccatgggaaaataagcattttttaaaatctgaagttgctcttttcctgtgtggtctttgggaggagtctagtacaaaaactgaaaacctttggtcctgggaatttattttcatggctgttgtcatggctgagtagttttttgatgaattcaatcaatgcagagaacgcttttagataaatcagaactctccttaaaatgcatttcaatcagaagcaaagtacacccattatttatgcagacatgtaaaaaatctaaaaattcttgcaatgagtagtataagccacctatttttacttccttctctgaaatattccagttaactcagcttgggttctgtgctcctcctctcttcctatagaacactgtgcataccttgaataaagagcttattatactaaaaaaaaaaaaaaaaaaaaa

SEQ ID NO: 3790 - DNA, 3512 bp, Homo sapiens
gacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagagagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagccacaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttaggatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaag

SEQ ID NO: 3791 - DNA, 3100 bp, Homo sapiens
gtcggcggcggctgcgggaactttcccagcggatctaatggctgcgcgcgggccgctgtgaggcgcggcggcgagcgacgggcgcggggccgcggagcagcgagcgagcgagcgagcgcgaggccggagccccggccaggcccggccgacccgccgagcccgcgatgcgccccggggccgccccccggcgcagctgacgccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcgggtgagtgtgtgctgccccagccctgggcacagagggatgtggagcgctgggtctggtctggcccagccctggtgacagggccccaggggtgggggtcggagagcgaggagaaggttgtcacctatgaccacattgggcccaacgtctgcatgggagaccacaagcccgtgttcctggccttccgaatcatgcccggggcaggtaaacctcatgcccatgtgcacaagtgttgtgtcgtgcagtgacgtggtgggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggttttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaataaaaaaaaaaaaaaaaaaaaaaa

SEQ ID NO: 3792 - DNA, 4955 bp, Homo sapiens
tctcctcctaccggtcgggtgccccggggcgttccctctgccgctgcttctcggcgcggttcctacccggccgctccccgaggcgcgggctctggcggcctcgaccgactaggacgccccgtgcgccgcccgcgggccgccgcctccctgggcgcgcggggccagcatggagctcttccaagccaaggaccactacatcctgcagcagggcgagcgcgcgctgtggtgcagccgccgcgacggcggcctccagctccgacccgctactgatctacttcttgcctggaatcccatttgtttggggttggtagaaggtgttattgggaaaattcaacttcattcagatcttccatggtggcttattctaattcggcagaaagcattggtgggcaaactcccaggagaccatgaggtctgtaaagttaccaaaattgctgtgctctcactttctgaaatggaacctcaggatcttgagctagagctctgtaagaagcatcattttggtattaacaaaccagagaagatcataccatctcctgatgactcaaagtttctactgaagacctttacgcatattaaatccaatgtgtctgctcctaataaaaagaaagttaaggaaagtaaagagaaggagaagttggagaggagattacttgaagagttgctgaagatgttcatggactcagaatccttttattatagcttgacctatgacctgaccaattccgtgcagaggcagagcactggggagagggacggtcggcccctctggcagaaggttgatgaccgatttttttggaataaatacatgatacaagatcttactgagattggtactccagatgtggacttttggattatccccatgatccaaggttttgtgcagattgaagaacttgtggttaattataccgaatcatctgatgatgagaaaagcagcccagagaccccccctcaggagtccacctgtgtagatgatattcacccacgatttctagtggctctcatttcacgccgaagtaggcacagagcaggaatgcgctataaacgaagaggagtggataaaaatggaaatgttgccaattatgtggagactgagcagttgattcatgttcataatcataccctgtcatttgttcaaacacgaggctctgtgcctgtcttttggagccaggttgggtatcgatataacccaagaccgcggctggacagaagtgaaaaggaaactgttgcctatttctgtgcccatttcgaagaacaactgaacatttacaaaaaacaggttattattaacttggtagaccaggcaggaagagagaagattattggcgatgcttacctgaagcaagtgttgcttttcaacaactcacacctcacttacgtttcgtttgacttccatgagcactgccgaggaatgaagtttgagaatgttcagacactaacagatgccatttatgacattattcttgatatgaagtggtgttgggttgatgaagctggggtaatatgtaagcaggaagggatttttcgtgttaattgtatggactgcctggatcgcaccaacgtggtccaagctgccatcgcgagagtggtcatggaacagcagctgaaaaaattaggtgtgatgcccccggaacagccattacctgtgaaatgtaatcgcatctaccagataatgtgggccaataatggtgactccattagcagacagtatgctgggacagctgctctgaagggtgactttacaaggacaggagaaaggaagttagcaggagttatgaaagatggagtgaactcagcaaacagatattacctcaaccgatttaaggatgcttataggcaagctgttatagatttgatgcaaggcattccagtgacagaagatctttattccatatttaccaaggagaaagaacatgaagctttgcataaggaaaatcagagaagccaccaggaactaattagccagctcttacaaagttacatgaagttactactgcctgatgatgagaagttccatgggggctgggccctcattgactgtgaccctagcctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatattggcaacctccgaaagctaggaaactttaccaaacctgaaatgaaagttaactttctaaaaccaaacttaaaagtaaatctttggaaatcagatagtagtcttgaaactatggaaaacacaggagtgatggataaggttcaggcagagtctgatggggacatgtcttcagataatgactcataccactctgatgaattccttacaaattctaagtctgatgaagacaggcagctagctaactcattagagagtgtagggccaatagattacgttcttcctagttgtggtattattgcctcagcgcctcgattgggcagtcggtcccagtctcttagcagcacagatagtagcgttcatgctccttcagagattactgttgctcatgggagtgggcttggaaaaggccaggagtctcctttgaagaaaagtccttctgctggcgacgtacacatattgactggctttgccaagcctatggatatttactgccacagatttgtgcaagatgcacagaacaaagtgacccacctatcagagaccagatctgtgtctcagcaggctagtcaggaaagaaatcaaatgaccaatcaagtttcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagacagggcttcatgtaactccttctccttcagagagcagtagcagcagagcagtctctccctttgccaagattcgaagttccatggtccaggttgctagtattacccaagctggattaacccatgggataaactttgcagtgtcaaaagttcagaagagtcctccagaacctgaaatcattaatcaagtccagcaaaatgaacttaaaaagatgtttatacaatgccagacacggataattcagatttagcttttagccataagaatccttccatggcttttatttaaaaatatgaaattttcacctcttggggtattttaattgtactgtctgaacccagggatcacaaattctgttcattggaaagggttttaaacggagtcggaacctgagtagatttccaaattttacagccaggactacagaagtgcatcattctagaatgtgtagacctgagtagcttatacactacagagcactttgcttatttgaaagtaattcagcaacaggtcactttgggatataacctgaacctttttttggagtggggtgggtagactacagtagacacaagggctggacatgcagatgcttaggggattagcgtttttcataatttgttctgtttgtcagttcattcctgtgtgttcttacctctacaaagtaaattacacatttagtttttagtgactttaacatgttactgaagcatttgaatataaagctattttagttttgatggcttaactgttccctgaggagttgagggttattgacactagagaaatgaattctcatttgatcctaattttccccgtattctacttgaacacattaaaaatactctgctgcctatacaatgtaaacctaggagcattaagacttgtcacacagtaaacctgatacatcagaggtgaataccagcacctattaggtttcattttgctgttttcaggaatgtaagaacacccatattggctactggaaattctagaagtcagtcaggttttaatttattccaggaggggcatcctcgacatcttatgtagatgatccacaacttcaaaatttagtctgggcctagtgcagtggctcacacctataatcccaacactttgggaggccaggagttttgagaccagcctgggaaacatctgtctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaatttaaagtgaaaaaaaaaaaaaaaaaaaaaaaa

SEQ ID NO: 3793 - DNA, 3167 bp, Homo sapiens
aatatttactgcagctaagacttcagtaaaattgggggtggggggagggttgacattttccgactgcctgttacgtgccaagtgctttttgttaaggacataatgtttttgactggggatcatgtttggctgatgtaaatattaatgccaaaataggagctaggatgaaagtaacactgtaattagtagtagaatttatttcatattaaaatgtgtcatgacgtaatttttatggcttggctcaagcaacaattttcagagtgcaccctcattgatgctactcacagagacgtggatgtgctgttactgctttctaactctgcctactacgtggcctaatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatattggcaacctccgaaagctaggaaactttaccaaacctgaaatgaaagttaactttctaaaaccaaacttaaaagtaaatctttggaaatcagatagtagtcttgaaactatggaaaacacaggagtgatggataaggttcaggcagagtctgatggggacatgtcttcagataatgactcataccactctgatgaattccttacaaattctaagtctgatgaagacaggcagctagctaactcattagagagtgtagggccaatagattacgttcttcctagttgtggtattattgcctcagcgcctcgattgggcagtcggtcccagtctcttagcagcacagatagtagcgttcatgctccttcagagattactgttgctcatgggagtgggcttggaaaaggccaggagtctcctttgaagaaaagtccttctgctggcgacgtacacatattgactggctttgccaagcctatggatatttactgccacagatttgtgcaagatgcacagaacaaagtgacccacctatcagagaccagatctgtgtctcagcaggctagtcaggaaagaaatcaaatgaccaatcaagtttcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagacagggcttcatgtaactccttctccttcagagagcagtagcagcagagcagtctctccctttgccaagattcgaagttccatggtccaggttgctagtattacccaagctggattaacccatgggataaactttgcagtgtcaaaagttcagaagagtcctccagaacctgaaatcattaatcaagtccagcaaaatgaacttaaaaagatgtttatacaatgccagacacggataattcagatttagcttttagccataagaatccttccatggcttttatttaaaaatatgaaattttcacctcttggggtattttaattgtactgtctgaacccagggatcacaaattctgttcattggaaagggttttaaacggagtcggaacctgagtagatttccaaattttacagccaggactacagaagtgcatcattctagaatgtgtagacctgagtagcttatacactacagagcactttgcttatttgaaagtaattcagcaacaggtcactttgggatataacctgaacctttttttggagtggggtgggtagactacagtagacacaagggctggacatgcagatgcttaggggattagcgtttttcataatttgttctgtttgtcagttcattcctgtgtgttcttacctctacaaagtaaattacacatttagtttttagtgactttaacatgttactgaagcatttgaatataaagctattttagttttgatggcttaactgttccctgaggagttgagggttattgacactagagaaatgaattctcatttgatcctaattttccccgtattctacttgaacacattaaaaatactctgctgcctatacaatgtaaacctaggagcattaagacttgtcacacagtaaacctgatacatcagaggtgaataccagcacctattaggtttcattttgctgttttcaggaatgtaagaacacccatattggctactggaaattctagaagtcagtcaggttttaatttattccaggaggggcatcctcgacatcttatgtagatgatccacaacttcaaaatttagtctgggcctagtgcagtggctcacacctataatcccaacactttgggaggccaggagttttgagaccagcctgggaaacatctgtctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaatttaaagtgaaaaaaaaaaaaaaaaaaaaaaaa

SEQ ID NO: 3794 - DNA, 2456 bp, Homo sapiens
aaaaaaccccgaccgccggcctggcgcgcggctgcgcccaccggctccgcgctgctgccgccgccaccgccaccccgccgccgccccggcccgcgggccgcccaggctagtacccgggccggcctgcctccgccggccgtccgggtgcccgccgccgcgccgcgccccggccgggcgtggatggagggcgccgcgcgccctgcccgctgctcggcgtgacgcgggccccgcgccccgcgcccaccatgtcctacccgcagggctacctgtaccaggcgcccggctcgctggcgctctactcgtgcccggcctacggcgcatcggctttggcggctccgcgcagcgaggagctggcgcgctcggcgtcgggctcggcgttcagcccctacccgggctcggcggccttcacggcgcaggcggccaccggcttcgggagcccgctgcagtactcggccgacgccgccgccgccgccgccggcttcccgtcctacatgggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccccgagaaacaaaagcgaagatgaggacgaggacgagggcgacgctaccagaagcaaggacgagagtcccgacaaggcgcaggagggcacggagacctcggcagaggacgaagggatcagcctgcacgtggactcgctcacggatcactcgtgctcggccgagtcggacggggagaagcttccgtgccgcgccggggaccccctgtgcgaatcgggctcggagtgcaaggacaagtatgacgacctggaggacgacgaggacgacgacgaggagggcgagcggggcctggcgccgcccaagcccgtgacctcgtcgccgcttaccggcttggaggcgccgctgctgagccccccgcccgaggccgcgccccgcggtggccgcaagacgccccagggcagccggacgtctccgggcgcgccgccccccgccagcaagcccaagctgtggtcgctggccgagatcgccacgtcggacctcaagcagccgagcctgggcccgggctgcgggccaccggggctgcccgcggccgccgcgccggcctcaaccggggcaccgccaggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctacctatagaagggccgagcacagcaatgcaagtaagtgggcaccctggtgcttcccagaccctgtggagcctcccagcaccaacttgcttaatgtgtttttcttgcttctggtcatggggttagaagacagagcatttcaatcttgtccagcttttctttccttaagggggaaactatattttctgttttatagattccctctttttggcacaagttctatcactcctttacctagggaaggaaaaaaatatatatatatatgtgtgtgtgtgtgtgtgtaatatatatatgtatatatatagtacatgtatatatatagtacatgtgtatatatatattacacactactgttgttttcttttgaaacaatagattattaaaatctgggcatttatatgcaatttagagccatttttactatgctagacacataatagacacatgctttgatgagcttgggctaccaaaacttggagtagcaaaaacctttatagatgatgtttgcaaaataagactgaagagacacgaggcgtactagtcttttatcagccctgcccaacctcccctccacccatgtccaagtggacaggactctgacattctcccggggctcacaacagtatctcaaaaaatatgttgctttgcaacgagtcagaattactaatcatagatcttgaagataagaaagatttggaaccacttcagatcaactcgtttttataatggtgttgttgtggaactgaaagattggggatgatttggttttttccttggtccacaggtaggtgtcacaattgctttg

SEQ ID NO: 3795 - DNA, 4267 bp, Homo sapiens
attcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaaaaaaaaaaaa

SEQ ID NO: 3796 - DNA, 3700 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagacttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 3797 - DNA, 3399 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttcatgtggccgatatttttatttctttaatgattttgatcctaaatctgccttttcatctaatgtgaagtagaatcctaaataatgttatctgtgtagcaagctattcaatgggaaagctgcttctttctttaaaacaaacaaacaaaaaaaaccttcagtggaaagccaaattccaaaaggttatataccaagcttgtccaactcgcagctcgtcggccaggacatgcagcccagaatagctttgaatgtggccccaacacaaatttgtaaactttcttagaaattgtaattattattattatttttttttggtaactttttttaaagctcatcagctatcgttagtgtattttatgtgtggcccaagacagttcttcttcttgccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgacttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttcccgaattc

SEQ ID NO: 3798 - DNA, 2516 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgtctctctctgtcgcccagcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagta

SEQ ID NO: 3799 - DNA, 2481 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagta

SEQ ID NO: 3800 - DNA, 2498 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagta

SEQ ID NO: 3801 - DNA, 2533 bp, Homo sapiens
gagccagcccagccgcgttccgaacgcgagggtcgccggcctgggcgctgtcacgtcggggctgccggagctgcgggggaccgggcccgaacggcccctgacacctgcggtctcccgccgggctgggcaagcgcagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatga

SEQ ID NO: 3802 - DNA, 7506 bp, Homo sapiens
gacagaaaaaaaaatctctctttgtcttgagggggctgttgagtggtcgcggacctgggctctgtgcgttgggaaagggaagtggaggtctctgaaagaagatgaatttggctgagatttgtgataatgcaaagaaaggaagagaatatgcccttcttggaaattacgactcatcaatggtatattaccagggggtgatgcagcagattcagagacattgccagtcagtcagagatccagctatcaaaggcaaatggcaacaggttcggcaggaattattggaggaatatgaacaagttaaaagtattgtcagcactttagaaagttttaaaattgacaagcctccagatttccctgtgtcctgtcaagatgaaccatttagagatcctgctgtttggccaccccctgttcctgcagaacacagagctccacctcagatcaggcgtcccaatcgagaagtaagacctctgaggaaagaaatggcaggagtaggagcccggggacctgtaggccgagcacatcctatatcaaagagtgaaaagccttctacaagtagggacaaggactatagagcaagagggagagatgacaagggaaggaagaatatgcaagatggtgcaagtgatggtgaaatgccaaaatttgatggtgctggttatgataaggatctggtggaagcccttgaaagagacattgtatccaggaatcctagcattcattgggatgacatagcagatctggaagaagctaagaagttgctaagggaagctgttgttcttccaatgtggatgcctgactttttcaaagggattagaaggccatggaagggtgtactgatggttggacccccaggcactggtaaaactatgctagctaaagctgttgccactgaatgtggtacaacattcttcaacgtttcgtcttctacactgacatctaaatacagaggtgaatctgagaagttagttcgtctgttgtttgagatggctagattttatgcccctaccacgatcttcattgatgagatagattctatctgcagtcgaagaggaacctctgatgaacatgaggcaagtcgcagggtcaagtctgaactgctcattcagatggatggagttggaggagctttagaaaatgatgatccttccaaaatggttatggtattggctgctactaatttcccgtgggacattgatgaagctttgcgaagaaggttagaaaaaaggatatatatacctctcccaacagcaaaaggaagagctgagcttctgaagatcaaccttcgtgaggtcgaattagatcctgatattcaactggaagatatagccgagaagattgagggctattctggtgctgacatcactaatgtttgcagggatgcctctttaatggcaatgagacggcgtatcaatggcttaagtccagaagaaatccgtgcactttctaaagaggaacttcagatgcctgttaccaaaggagactttgaattggccctaaagaaaattgctaagtctgtctctgctgcagacttggagaagtatgaaaaatggatggttgaatttggatctgcttgaatttctgtcagctctttaatttctggtatttttgttgataaaatacgaagaaattcctgcaatttttaaaaaacaagtttggaatttttttcagtggagtggttttcgcttaaaggaaaaaaaaatctaaaactgcgaagaatactaaatgtagttgagaaataattgatggcgagagtttgctagtctccctccccggctttgtgctggtattccacgtattcctgcattaatattgcacacccaaaccagtctatcagggaggctgaagcaagggcgcagtgtgatattttaggaatacagaagatttagaaatacccctatttctcatttgcagtttttttttccaattctgtgctctgtcaacatgagggacctatctatgtatgttgacttttaacatcaaaattggatttgtgtcaaacattcattgttaagagaagaatgacagtatattttggaggaaataatgaatttactaattaaacctttagaatttatgacttactgttagagtctgtcatatggttagaatttttacttccgctacccctgccatttcttctgctagctacttcataatatcttgagctttactgaggaatattctcacgctctgtggtatttgaatcattttgccaggtcatttctctgtctttagtattttttgctggtgcttcttacatttaatatggaaaggtgggaagaatattactgcattagatgtaattcttcattctagacttccaagtttgttttcacttttttgtgtgtgcgtgaaggagtctgtgtcacccaggctgtgtagtgcagtggttgatcttggctcactgcaacctctgcctcctagattcaagcaattctcctgtctcagcctcccaagtagctgggattacaggtgcgcaccaccatgcctggctgtgttttcacttttctttcaacatgttcaaccagatatatagccattatttttctcagctccagcattgtttgatttttcttgagtttgattttagtatttgagataaatacttttacattctaaacaagtccactctctgtggctaacgcaaaacaaatgaaatctttattgttttccaaacagctagtttaacaaaacagcatcatacatagtgaatgatgttcattggaaaattctaaaatttgtccttgtctaggttgagaacttttacacacactaagataaagatagaaatctgacatgctcactcaattcagcaggaattacacattagaaagaagccagaaaaataaatggcatatatccaatcacaagtaaatgatcctggcgttagtttttatgattacatgtgtctcattaggcaatttatgctttaatggtcaagcttttaaaaatttgtatttgataacatcctgaattctcagtttcgaatagtgcctactggtttaaaactaaaaataatacagctttttggacatttaaccaagatactaagaaggttttttttaaaaaaagagatttgattatttttccctgctaaaaactgtaaatgccttatgttcttttcagataacttaagtctgacctaaactccagtattcatctgatgctgtaaattgcccttctttctgagacacagattataagatgccagatcataagacatcatgattttattgtaattgaattcttcctaaaaattgagaggtttccttttattaacttttaaaataaagaaataagtagtttcattacgattattttgcaaactattgccagtcagaaatgcactttttttttccctgaagttttaggagccgtcactaaaacattagtcttgtgattgttaaaacttgtttgtaatgggttggtgcaaaagtaattgtggtttttccattactttcaatggcaaaaaccgcaattacttttgcaccagcctaacaatagttgattagttagaccttttctgggttttgtattgattatcttggtgtgcatttaattatttttctgaattcttcatggataatgacatagtaattgtgattcttttaataccagttaagcagtatttggcaacttaaacttcctgggagcctaactttactatgttaagtgagtcaggtgtgctttttatttcccttgtttctcattttgccctgtcagtggatggtagatgctttgtatatcttaaatcccttaaaggatcttaaagacatccctcaggtgttctatttaacttttattttattttattttatttatttatttattttgagactgagtcttgctctgtcgcccaggctggagtgcagtggcatgatctcggctcactgcaacttctgcctcccaggttcaagccattctcctgcctcggcctcctgagtagctgggattacagttgccgccacacccggcttatttttttgtatttttagtagaggcagagtttcaccatgttggccaggctagtctcgaactcctgacctcagatgatccgcccacattggcctcccaaagtgctgggattacaggtgtgatccaccgcacctggccctaacttttaatatacaacacacacacacacacacacacacacacacacacacacacacacacacacacacacactatttcagaagacagtgtgttgccttacccagaatgagtgctaggattacaggcgtgagacagacacacatacacacacatacacacacacagagtctttattgcagaagacagtgtgttgccttataggcgtgagacacacacacacacacacacacacacacacacacacacagtctttattgcagaagacagtgtgttgccttaccagaatgagtgcttggattacaggcgtgagccactgtgcccagccctaacttttaatgtacatcacacacacactcacactcacatacacacacacacacacactctgactgtctttattgcagaagacagtgtgttgccttacccagaatgagattgaattgttttgcttcgttttgttttgttattcagtgttgcggtagcagatgcattatcaaaggaaaaatatttggctcctttaattcctctgaaaacatgagtattttgagttctgcagcacaatgactgtaggactaagctaagtctgctttgcagatatctgatcagatagtcccttcattctgtagacgtgtattggttggtccaagacacagtgagtaggagctctgtggaccaagacaaagctggactagagagtacagttcaaacttggcagtttctctaacgactctgtatagcttctggcttctactactgaaacaagagtttagatcactgatggagaggcatagtaatctgtttgtgctttggaaaaatatataaaagtttttttcccctattttttgcactttaaatctgttttgaaattagaactgatatacatttatttgaataatgtgtaactattatggatctattttaatgaacaatttttaccatttcccaagctgcctgtttattataagcatgacatgtttactataaaccttttgcccccataatttctttttttaaaggaaattaatattagtaaaataaacacctctttaatggaagctgcaaccttctagtgatccaagtagacaatagatggtggcatcacagactttatctacacactttcgggtctgaccactacctcccacaatacctagccattttggaaggggaaaacatgcggtggtctagctgtatagctcagggcttaatttcagcttctgagattgtgatgtcatatttcactctcaaaacataggctgaaagcacgaattactcaaaaagtaagcaaaccaatacctggtgaatctatggacagtcatacacatacatcaggggaaaatgtgtgtgtacaacccaaatttacagtatgattgtcattctttgactttgttttgtatagcctgactctgttgaacatgaaattattagtactctaggttttggacagcttgagttcatttgaattccttccttaggaataagtttttatatacactgctaaatgtgtgatgagaatcataaaacactaaccagctgaggtagctgtgattcactttccccccaccctaacttgagataaaatgaaggactaggcaagtatttcatgttgtgtgagtggacttcggttccttcagtattgtctaggttattgagtctttctttgcctaatagtggattcccactcttaagataacttttattagtgataaatcagtttagggtatattctgtatgacaggcataaaatgttaagggtgaatgctggccttttccaagaaaaggccaccttaacttgtatgaggaaaaaatcctaactattctcttttttgtatctttttttccgtaactgttttgattgtatattttaaagaaaccacttaatttgtgatgcacgtaatatttgtgtgaacctgagaatatgtcacaataggaaaaagcagaaattatacttaggggacatgttaggggggtaaaaatatttaagcctcgaatgttttactgtcatctccactaactatttttacagaaaaagctaaaaactctgttgtaattattgtaagtttacttatttatacttttaaattaggcttttcatacttaaatttttttgacatttgcttttaatatttgtttcttaatgtggaaattgtgtattttaataatcaaattattaggataatagatatatttttaaacattcacctcattaacaaatagatctttgaatttttattaggttttttggctccagacaactgtttagctttaatgatatttctaaattcccagtgacttattaataaaaacaggaaaaatatttaggtaatgtcataaaatttattttacctttctcattttctgagaaaataaatgaaaaaaaccctagatattgctttattaccaacagtgtgtaggtttttgtacatatggaaatttgacacaaaaaaatagggaatttgtatagagaagtttccctcttataaaaggactcccatttgattgttcgaaactataaaatgcacttttactttaccatatctgaaatgacaaaatatcgccctttggaaaacctgactctttgcacgtgtaattcccagagtctacctcagttaaccaggcttagttttaggcaggaatgaattgaattaaattcagttcatcatctatgcagatttgtttcttttaagcacatccttccctcctgctgttgccctcctcccattaacttttctttttaatcttgaaattgtttaaaatattccatctttctttctctagcaaagtgtttgtattccaaataaggcctctgtgaaatgtctgaattacttttcccgtctttgttatggtcagcttcattatttggatgtattgcattcaaagcagcagttccaaacataacacacatctattttcttagagttttgtaaatacaaactaacctgatgacattaaaaattgtggatcctacatgttcctatgttcattctctaaaaacctgagtaactttatgaaaacacacaaacctggaaaaacatcacatttttgtcacatttttactgacaaatgtatattcatatgatggtacggcagcagggagtggcccccagttaacatggctgtgagtggacacagtgtctcgcaggatcactgcatgttatgatggcttgtaagtgcgttgttaagacttttgtttcagtgtttgtctcccagtatttgaacctaatttaaagaaaaagacgtttccaagttgtatttattaaatgtgtttttccttaccttttgtgctgctactttgctaatctcattagcttagctgtgtttgtgcataggttatatttggtaataaatttatagagtgttggttgtcaaaaaaaaaaaaaaaaaaaaaaa

SEQ ID NO: 3803 - DNA, 7536 bp, Homo sapiens
ccttttcacgcgcgtcgcgagctaacggactcggcggcggcggcggcggcggcctgcgccccacccgcaccccatctggaccgcatcgctgaatgtgcccggacctgcgccttctgggtctctgaaagaagatgaatttggctgagatttgtgataatgcaaagaaaggaagagaatatgcccttcttggaaattacgactcatcaatggtatattaccagggggtgatgcagcagattcagagacattgccagtcagtcagagatccagctatcaaaggcaaatggcaacaggttcggcaggaattattggaggaatatgaacaagttaaaagtattgtcagcactttagaaagttttaaaattgacaagcctccagatttccctgtgtcctgtcaagatgaaccatttagagatcctgctgtttggccaccccctgttcctgcagaacacagagctccacctcagatcaggcgtcccaatcgagaagtaagacctctgaggaaagaaatggcaggagtaggagcccggggacctgtaggccgagcacatcctatatcaaagagtgaaaagccttctacaagtagggacaaggactatagagcaagagggagagatgacaagggaaggaagaatatgcaagatggtgcaagtgatggtgaaatgccaaaatttgatggtgctggttatgataaggatctggtggaagcccttgaaagagacattgtatccaggaatcctagcattcattgggatgacatagcagatctggaagaagctaagaagttgctaagggaagctgttgttcttccaatgtggatgcctgactttttcaaagggattagaaggccatggaagggtgtactgatggttggacccccaggcactggtaaaactatgctagctaaagctgttgccactgaatgtggtacaacattcttcaacgtttcgtcttctacactgacatctaaatacagaggtgaatctgagaagttagttcgtctgttgtttgagatggctagattttatgcccctaccacgatcttcattgatgagatagattctatctgcagtcgaagaggaacctctgatgaacatgaggcaagtcgcagggtcaagtctgaactgctcattcagatggatggagttggaggagctttagaaaatgatgatccttccaaaatggttatggtattggctgctactaatttcccgtgggacattgatgaagctttgcgaagaaggttagaaaaaaggatatatatacctctcccaacagcaaaaggaagagctgagcttctgaagatcaaccttcgtgaggtcgaattagatcctgatattcaactggaagatatagccgagaagattgagggctattctggtgctgacatcactaatgtttgcagggatgcctctttaatggcaatgagacggcgtatcaatggcttaagtccagaagaaatccgtgcactttctaaagaggaacttcagatgcctgttaccaaaggagactttgaattggccctaaagaaaattgctaagtctgtctctgctgcagacttggagaagtatgaaaaatggatggttgaatttggatctgcttgaatttctgtcagctctttaatttctggtatttttgttgataaaatacgaagaaattcctgcaatttttaaaaaacaagtttggaatttttttcagtggagtggttttcgcttaaaggaaaaaaaaatctaaaactgcgaagaatactaaatgtagttgagaaataattgatggcgagagtttgctagtctccctccccggctttgtgctggtattccacgtattcctgcattaatattgcacacccaaaccagtctatcagggaggctgaagcaagggcgcagtgtgatattttaggaatacagaagatttagaaatacccctatttctcatttgcagtttttttttccaattctgtgctctgtcaacatgagggacctatctatgtatgttgacttttaacatcaaaattggatttgtgtcaaacattcattgttaagagaagaatgacagtatattttggaggaaataatgaatttactaattaaacctttagaatttatgacttactgttagagtctgtcatatggttagaatttttacttccgctacccctgccatttcttctgctagctacttcataatatcttgagctttactgaggaatattctcacgctctgtggtatttgaatcattttgccaggtcatttctctgtctttagtattttttgctggtgcttcttacatttaatatggaaaggtgggaagaatattactgcattagatgtaattcttcattctagacttccaagtttgttttcacttttttgtgtgtgcgtgaaggagtctgtgtcacccaggctgtgtagtgcagtggttgatcttggctcactgcaacctctgcctcctagattcaagcaattctcctgtctcagcctcccaagtagctgggattacaggtgcgcaccaccatgcctggctgtgttttcacttttctttcaacatgttcaaccagatatatagccattatttttctcagctccagcattgtttgatttttcttgagtttgattttagtatttgagataaatacttttacattctaaacaagtccactctctgtggctaacgcaaaacaaatgaaatctttattgttttccaaacagctagtttaacaaaacagcatcatacatagtgaatgatgttcattggaaaattctaaaatttgtccttgtctaggttgagaacttttacacacactaagataaagatagaaatctgacatgctcactcaattcagcaggaattacacattagaaagaagccagaaaaataaatggcatatatccaatcacaagtaaatgatcctggcgttagtttttatgattacatgtgtctcattaggcaatttatgctttaatggtcaagcttttaaaaatttgtatttgataacatcctgaattctcagtttcgaatagtgcctactggtttaaaactaaaaataatacagctttttggacatttaaccaagatactaagaaggttttttttaaaaaaagagatttgattatttttccctgctaaaaactgtaaatgccttatgttcttttcagataacttaagtctgacctaaactccagtattcatctgatgctgtaaattgcccttctttctgagacacagattataagatgccagatcataagacatcatgattttattgtaattgaattcttcctaaaaattgagaggtttccttttattaacttttaaaataaagaaataagtagtttcattacgattattttgcaaactattgccagtcagaaatgcactttttttttccctgaagttttaggagccgtcactaaaacattagtcttgtgattgttaaaacttgtttgtaatgggttggtgcaaaagtaattgtggtttttccattactttcaatggcaaaaaccgcaattacttttgcaccagcctaacaatagttgattagttagaccttttctgggttttgtattgattatcttggtgtgcatttaattatttttctgaattcttcatggataatgacatagtaattgtgattcttttaataccagttaagcagtatttggcaacttaaacttcctgggagcctaactttactatgttaagtgagtcaggtgtgctttttatttcccttgtttctcattttgccctgtcagtggatggtagatgctttgtatatcttaaatcccttaaaggatcttaaagacatccctcaggtgttctatttaacttttattttattttattttatttatttatttattttgagactgagtcttgctctgtcgcccaggctggagtgcagtggcatgatctcggctcactgcaacttctgcctcccaggttcaagccattctcctgcctcggcctcctgagtagctgggattacagttgccgccacacccggcttatttttttgtatttttagtagaggcagagtttcaccatgttggccaggctagtctcgaactcctgacctcagatgatccgcccacattggcctcccaaagtgctgggattacaggtgtgatccaccgcacctggccctaacttttaatatacaacacacacacacacacacacacacacacacacacacacacacacacacacacacacactatttcagaagacagtgtgttgccttacccagaatgagtgctaggattacaggcgtgagacagacacacatacacacacatacacacacacagagtctttattgcagaagacagtgtgttgccttataggcgtgagacacacacacacacacacacacacacacacacacacacagtctttattgcagaagacagtgtgttgccttaccagaatgagtgcttggattacaggcgtgagccactgtgcccagccctaacttttaatgtacatcacacacacactcacactcacatacacacacacacacacactctgactgtctttattgcagaagacagtgtgttgccttacccagaatgagattgaattgttttgcttcgttttgttttgttattcagtgttgcggtagcagatgcattatcaaaggaaaaatatttggctcctttaattcctctgaaaacatgagtattttgagttctgcagcacaatgactgtaggactaagctaagtctgctttgcagatatctgatcagatagtcccttcattctgtagacgtgtattggttggtccaagacacagtgagtaggagctctgtggaccaagacaaagctggactagagagtacagttcaaacttggcagtttctctaacgactctgtatagcttctggcttctactactgaaacaagagtttagatcactgatggagaggcatagtaatctgtttgtgctttggaaaaatatataaaagtttttttcccctattttttgcactttaaatctgttttgaaattagaactgatatacatttatttgaataatgtgtaactattatggatctattttaatgaacaatttttaccatttcccaagctgcctgtttattataagcatgacatgtttactataaaccttttgcccccataatttctttttttaaaggaaattaatattagtaaaataaacacctctttaatggaagctgcaaccttctagtgatccaagtagacaatagatggtggcatcacagactttatctacacactttcgggtctgaccactacctcccacaatacctagccattttggaaggggaaaacatgcggtggtctagctgtatagctcagggcttaatttcagcttctgagattgtgatgtcatatttcactctcaaaacataggctgaaagcacgaattactcaaaaagtaagcaaaccaatacctggtgaatctatggacagtcatacacatacatcaggggaaaatgtgtgtgtacaacccaaatttacagtatgattgtcattctttgactttgttttgtatagcctgactctgttgaacatgaaattattagtactctaggttttggacagcttgagttcatttgaattccttccttaggaataagtttttatatacactgctaaatgtgtgatgagaatcataaaacactaaccagctgaggtagctgtgattcactttccccccaccctaacttgagataaaatgaaggactaggcaagtatttcatgttgtgtgagtggacttcggttccttcagtattgtctaggttattgagtctttctttgcctaatagtggattcccactcttaagataacttttattagtgataaatcagtttagggtatattctgtatgacaggcataaaatgttaagggtgaatgctggccttttccaagaaaaggccaccttaacttgtatgaggaaaaaatcctaactattctcttttttgtatctttttttccgtaactgttttgattgtatattttaaagaaaccacttaatttgtgatgcacgtaatatttgtgtgaacctgagaatatgtcacaataggaaaaagcagaaattatacttaggggacatgttaggggggtaaaaatatttaagcctcgaatgttttactgtcatctccactaactatttttacagaaaaagctaaaaactctgttgtaattattgtaagtttacttatttatacttttaaattaggcttttcatacttaaatttttttgacatttgcttttaatatttgtttcttaatgtggaaattgtgtattttaataatcaaattattaggataatagatatatttttaaacattcacctcattaacaaatagatctttgaatttttattaggttttttggctccagacaactgtttagctttaatgatatttctaaattcccagtgacttattaataaaaacaggaaaaatatttaggtaatgtcataaaatttattttacctttctcattttctgagaaaataaatgaaaaaaaccctagatattgctttattaccaacagtgtgtaggtttttgtacatatggaaatttgacacaaaaaaatagggaatttgtatagagaagtttccctcttataaaaggactcccatttgattgttcgaaactataaaatgcacttttactttaccatatctgaaatgacaaaatatcgccctttggaaaacctgactctttgcacgtgtaattcccagagtctacctcagttaaccaggcttagttttaggcaggaatgaattgaattaaattcagttcatcatctatgcagatttgtttcttttaagcacatccttccctcctgctgttgccctcctcccattaacttttctttttaatcttgaaattgtttaaaatattccatctttctttctctagcaaagtgtttgtattccaaataaggcctctgtgaaatgtctgaattacttttcccgtctttgttatggtcagcttcattatttggatgtattgcattcaaagcagcagttccaaacataacacacatctattttcttagagttttgtaaatacaaactaacctgatgacattaaaaattgtggatcctacatgttcctatgttcattctctaaaaacctgagtaactttatgaaaacacacaaacctggaaaaacatcacatttttgtcacatttttactgacaaatgtatattcatatgatggtacggcagcagggagtggcccccagttaacatggctgtgagtggacacagtgtctcgcaggatcactgcatgttatgatggcttgtaagtgcgttgttaagacttttgtttcagtgtttgtctcccagtatttgaacctaatttaaagaaaaagacgtttccaagttgtatttattaaatgtgtttttccttaccttttgtgctgctactttgctaatctcattagcttagctgtgtttgtgcataggttatatttggtaataaatttatagagtgttggttgtcaaaaaaaaaaaaaaaaaaaaaaa

SEQ ID NO: 3804 - DNA, 3301 bp, Homo sapiens
atgcacaggcctgggcagggacacacaaccaacagctctgtcgggaacttaggagcctgctcgcctacaaaaatgataagagagatctaaagaaaacaagctaaaccttttgagggacatactgaagccagataacccaaggtattcacagcaagatacagtgagtcttaaagttaagcaccgtgcaattagctttgcttccttgggtttttgaaacatgcatctgtataaacctgcctgtgcagacatcccgagccccaagctgggtctgccaaaatccagtgaatcggctctaaaatgtagatggcacctagcagtgaccaagactcagcctcaggcggcctgcaaacctgtgaggcccagtggagcagccgaacagaaatatgtggaaaagtttctacgtgttcatggaatttcgttgcaggaaaccaccagagcagagacgggcatggcatacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatctt

SEQ ID NO: 3805 - DNA, 4094 bp, Homo sapiens
agttgcaactgttgtgctgcagcagatttggtctgagtctgggcagagcccctttttatggagcaaccctcccgatttgttacagcaagagcctggtgcaagtgatctttgccttcccatcgcacacaaaggcaaagagctccttaaagggacctgcctgctcctccgtgcagctgcaaacccgtgtcggtgcaggctcagcaacccaggctttcgctcgagaatgagtggggaggggtcttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggaccggctccgcgaagggctgcgtgcagtcaccatgaatgctcagctctaggcttctgtaaaaacctcccccactgcatggatttggctgtttaatcagccgagattacagcccgggaagatttgcaaacctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaagggggagcaaggagggcttaaaagaaaagcagaaatccccgcaactgctcaacctctcgtgactgcctgtgttctggggttctgagagggaccgtgcgctgcctggggaagcaatgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaaaaaaaaaa

SEQ ID NO: 3806 - DNA, 3170 bp, Homo sapiens
ttcagattactttgatgacagtgacttccagtcttctctgaaagatctccacgatgctggcagcccggacaggggcagcggggagtcagatctcagaggagaacaccaagttaaggagacagtctgggttttctgtagcagggaaagacaaatctcccaagaaagcctcagaaaacgctaaagacagcagccttagtccctcaggggaaagccagctcagggcgcgtcaactggctctgctgcgcgaagtggagatgaactggtacctaaagctctgcgacctgtccagcgagcacaccaccgtctgcaccacaggcatgccgcacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatctt

SEQ ID NO: 3807 - DNA, 3920 bp, Homo sapiens
gtgggccgctcccctctgggaggagggctgcccagaggggtgcgggtgtcgctagcggcccctccccgtgtggggccacgtggcgggtgcgggccgagcccgaggggaagaacctggcccgtggggaggtgggggggaccgaaacggcgctgagccgagccgagagctacggggttcggagcagaggcagcggcagcggcagcggcagtaagagggaggggaggaggcaggagggcgcatggggcgccccggcccctccgacagcgcgccccctccggcccggccgcgctgaaagctccccagcgccgcgccttgaacccacgccccggggccatgccggtcatgaaggggttgctggccccgcaaaacaccttcctggacaccatcgccacccgttttgacggaacgcacagcaacttcctgctggccaacgcacagggcacacggggctttcccatcgtctactgctccgacggcttctgcgagctcacaggctacggtcgcaccgaggtcatgcagaagacctgcagctgccgtttcctctacggcccagagaccagtgagccagccctgcagcgtctgcacaaagccctggagggccaccaggagcaccgggctgaaatctgcttctaccgcaaggatggctcagccttttggtgcctcctggacatgatgcccatcaagaatgagatgggggaggtcgtgctgttcctcttttccttcaaggatatcactcagagtggaagcccaggacttggcccccaaggaggccgcggggacagtaatcacgaaaactcccttggtagaaggggagccacctggaaatttcggtctgccagaagacggagccgtactgtcctacaccgactgaccggccactttggccgccggggccagggaggcatgaaggccaataataacgtgtttgagccaaagccatcagtgcccgagtacaaggtggcctccgtgggggggtctcgctgcctcctcctccactacagcgtctccaaggccatctgggacggccttatcctccttgccaccttctacgttgcggtcaccgtcccctacaatgtctgtttctcgggtgacgatgacacccccatcacttcgcgacacacccttgtcagcgacatcgccgtggaaatgctcttcatcctagatatcatcctgaacttccgcaccacctatgtgtcccagtccggccaggtaatctctgctcctcgttccattggcctccactacctggccacctggttcttcatcgaccttattgctgctctgccctttgacctgctttacatcttcaacatcaccgtgacctcgctggtgcacctactgaagacagtgcggctgttgcggctgctgcggctgctgcagaagctggagcggtactctcagtgcagtgctgtggtgctcacgctgctcatgtcggtctttgcgctccttgcccactggatggcctgcatctggtatgtcatcgggcgccgggagatggaggccaatgacccgctgctctgggacattggctggttgcatgagttgggcaagcgtctggaggtgccctatgtcaatggctcggtgggcggcccatcacggcgcagcgcctacatcgcggcactgtacttcactctaagcagcctcaccagtgtgggctttggcaacgtgtgtgccaacaccgacgcggagaagatcttctccatctgcacgatgctcataggcgccctgatgcacgctgtggtgttcgggaacgtgacagccatcatccagcgcatgtactcgcgccgctcgctctaccacagccgcatgaaggacctcaaggacttcatccgtgtgcaccgcctgccgcggccgctcaagcagcgcatgctcgaatacttccagaccacgtgggccgtcaacagcggcatcgacgccaacgagttactgcgtgacttcccagacgagctgagagctgacattgctatgcacctgaatcgggagatcctgcagctgccgttgttcggggcagcgagcaggggctgcctgcgggccctatcgctgcacatcaagacctcgttctgcgctccgggcgagtacctgttgcgccgtggggatgccctgcaggcacattactatgtctgctccggctcgcttgaggtgctccgagacaacatggtgctggccatcctggggaagggggacctgattggagcagatatccctgagccggggcaggagcctgggttgggagcagacccaaacttcgtgctaaagaccagtgctgatgtgaaagctctgacctactgtggcctgcagcagctgagcagccgagggctggctgaggtcctgaggctctatcctgagtatggggctgccttccgggctggcctgccccgggacctcaccttcaacctgcgccagggctctgacaccagtggcctcagccgcttttcccgatcccctcgcctctcccagccccgctcagaaagcctcggctcctcctcagacaagacgctgccatccatcacagaggccgagagtggcgcggagcctgggggtggtcccaggccccgacggcccctcctgctgcccaacctcagcccagcacggcctcggggctccctggtcagccttttgggcgaggagctgcccccattctcagcccttgtctcctctccttccttatccccatccctgtcccctgccctggctggccagggccacagtgcctcccctcacggcccccccaggtgctctgctgcctggaagccccctcagcttctcattcccccactgggaacctttggacctccggacctcagtccccggatagtggatggcattgaggactctggcagcacagctgaggccccttcattccgattcagcaggaggcctgaactgccaaggccccgctcccaggcgccccctacagggaccaggcccagcccagaattggccagtgaggctgaggaggtgaaggaaaaggtttgccggctgaaccaggagatctctcgtctcaatcaggaggtgtctcagcttagccgggagctgcggcacatcatgggcctgctgcaggccaggctgggtcccccaggccacccagcaggctccgcttggaccccagaccctccttgtccacagctgaggccaccatgcctctctccttgtgcgtccagaccaccacccagcctccaggatactacgcttgctgaagttcactgcccagccagtgtggggaccatggagacagggactgcgctcctggacttgagaccttccatattgcccccctacccctcagagcctgaccctctgggaccctctccagtgccagaggcctcacccccaaccccaagcctcttgaggcacagtttccagtccaggtcagacacgttccactgaccctggcccagggcccaggcctgtctggggtgggcgctgccgctcaccactcagggaggacctgggccccttggcttcctgccttggggtcagcagccaccagctggcctggttggctctggatttctggactttttaatgaagcgtggttacctctgacgctattcccttttccaagccttccccaacctccccctctgtgaggggagccacctgagggctgtggaacccagcaggcatgagatgaaccgcagtgcccattgggctgggcagatgagatcctactttctccccaggacctggaggcaggctgtctctcaaggtggtcttttctgctgctagcaactcaaaaatcccaacagcactccctatcctttccctgaccccagaccgctgccaagcctgttctcccccattacaacatggtctcactcagggcctggactgctccaaaactcgcccaggtctccagctctcctctaccccccaacaccctgggctcacttttggataggaaataaactctttatttt

SEQ ID NO: 3808 - DNA, 2608 bp, Homo sapiens
aaagggtggggggcgggggtagggggagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaattggccgggtcttccgctttctcggtgacagttcgctcccttcagcattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgcaaaaaaaaaaaaaaaaaaaa

SEQ ID NO: 3809 - DNA, 2563 bp, Homo sapiens
aaagggtggggggcgggggtagggggagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaacattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgcaaaaaaaaaaaaaaaaaaaa

SEQ ID NO: 3810 - DNA, 2509 bp, Homo sapiens
aaagggtggggggcgggggtagggggagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaaacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgcaaaaaaaaaaaaaaaaaaaa

SEQ ID NO: 3811 - DNA, 2434 bp, Homo sapiens
aaagggtggggggcgggggtagggggagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaaccctggtgccctctccttccaggaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgcaaaaaaaaaaaaaaaaaaaa

SEQ ID NO: 3812 - DNA, 2090 bp, Homo sapiens
ctcgccgccaaaccatgaaccgatgcccccgcaggtgccggagcccgctggggcaggcagcgcgatccctctaccagctggtgactgggtcgctgtccccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgcaaaaaaaaaaaaaaaaaaaa

SEQ ID NO: 3813 - DNA, 2413 bp, Homo sapiens
aaagggtggggggcgggggtagggggagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgcaaaaaaaaaaaaaaaaaaaa

SEQ ID NO: 3814 - DNA, 2636 bp, Homo sapiens
aaagggtggggggcgggggtagggggagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaattggccgggtcttccgctttctcggtgacagttcgctcccttcagcattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaactcttccctcccatcacatgagccacgtggaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgcaaaaaaaaaaaaaaaaaaaa

SEQ ID NO: 3815 - DNA, 3219 bp, Homo sapiens
cacggggcgaatgcggcgcgggctcctgcctctctgggtgggtgaggggcgcgcggatccggagagggggctccgggagcggcgggaccacgcagccacctgtgagccttcggcagctgcgggcggcggcggcgtacccggcccgagacgggaggagacgctcggcggcccccgcccgccggcccgccgggcgcacacactcgcacccgcgcacgcaccgccagcaggcagcggccaccgccgcgatgctcgcccgcgggttggggaagtttcccgccggcctcggccgcgggcacccgtgctcccaggtgtagcgcccccgcgcggcgcgggcggccggcgcctccagcatgaccggccagagcctgtgggacgtgtcggaggctaacgtcgaggacggggagatccgcatcaatgtgggcggcttcaagaggaggctgcgctcgcacacgctgctgcgcttccccgagacgcgcctgggccgcttgctgctctgccactcgcgcgaggccattctggagctctgcgatgactacgacgacgtccagcgggagttctacttcgaccgcaaccctgagctcttcccctacgtgctgcatttctatcacaccggcaagcttcacgtcatggctgagctatgtgtcttctccttcagccaggagatcgagtactggggcatcaacgagttcttcattgactcctgctgcagctacagctaccatggccgcaaagtagagcccgagcaggagaagtgggacgagcagagtgaccaggagagcaccacgtcttccttcgatgagatccttgccttctacaacgacgcctccaagttcgatgggcagcccctcggcaacttccgcaggcagctgtggctggcgctggacaaccccggctactcagtgctgagcagggtcttcagcatcctgtccatcctggtggtgatggggtccatcatcaccatgtgcctcaatagcctgcccgatttccaaatccctgacagccagggcaaccctggcgaggaccctaggttcgaaatcgtggagcactttggcattgcctggttcacatttgagctggtggccaggtttgctgtggcccctgacttcctcaagttcttcaagaatgccctaaaccttattgacctcatgtccatcgtccccttttacatcactctggtggtgaacctggtggtggagagcacacctactttagccaacttgggcagggtggcccaggtcctgaggctgatgcggatcttccgcatcttaaagctggccaggcactccactggcctccgctccctgggggccactttgaaatacagctacaaagaagtagggctgctcttgctctacctctccgtggggatttccatcttctccgtggtggcctacaccattgaaaaggaggagaacgagggcctggccaccatccctgcctgctggtggtgggctaccgtcagtatgaccacagtggggtacggggatgtggtcccagggaccacggcaggaaagctgactgcctctgcctgcatcttggcaggcatcctcgtggtggtcctgcccatcaccttgatcttcaataagttctcccacttttaccggcgccaaaagcaacttgagagtgccatgcgcagctgtgactttggagatggaatgaaggaggtcccttcggtcaatttaagggactattatgcccataaagttaaatcccttatggcaagcctgacgaacatgagcaggagctcaccaagtgaactcagtttaaatgattccctacgttagccgggaggacttgtcaccctccaccccacattgctgagctgcctcttgtgcctctggcacagcccaggcaccttatggttatggtgtaaggagtatgcccagcccctgaggggagagatgcatgggatatgcacccaggtttcttttacagtttttagaatcgtttttagagggtggtgtgtctgacaccatgcctttgcacctttccatgaaatgacactcactggtctttgcatcgtgggcataaaatgttcaccttttttccagatgagtacacccagaatgctaatttttctgtccatcgtgtacgctattctagtgcttgtggcccagtactgtctatgagttgtcgtgctcctgtttctgaggttgtcgtgtgagttctgtacaaaaagcccccacaagtcgtccagtagaaatgcatctatgaggtcagcaaggatatgatgagattttgctcacagtcatgtgaaaacaaaatctcagctctttatccattgctttcacttagttttagtaccaaaacaaagagaatgcaaagttaagcagacttgaccaatgcaagtctctaagttgtttttataaatgatctgtagttccgtggcttgcatgggtgcaccaatcatctttagaacgatgtacactgatgttcatctcataaatgtcactctttagagaatgttacttagttaaacatgcagtgaagatcgaatttttttcccaagaacagatgtgttagggagaggggcttcagctaaatagtccaaaccctagggtgcttaaagccaagttagtgcaggctgagccccttggttcacagtcaagcctccttgtttcctagggtgactgtagagaaatgtatttccggatgaggtttctgatctaggccatttgaccaaactttgctgtgtctaagatattagcatgtttttgaaatatttattttttaagatgtttaggagtaaggtcgtgttgtcttcctcaactaaaaagaagtttactgttgtatcgtctccctgaggtgaacgttgttgggttgctagcaagggcagtagcttaaatacttttgttgcctactctgaaagctcatcaaatgagagcccttttatttccaagcagaatttagtcagataattttgcttctaggatatagtatgttgtatatgatgctgtgattgccctggagttcctgccatgacatggaaacctggtggtatggaagcatgtactcaaaatatagacgtgcacgatggtggtgtggcttacccaggatggaaacactgcagtttttacttgcattcccactgcctttcatggggggtgactgggtagaggccaggagaaaggaaagagttgtaaaataaaaaactgctagttcataaaaaaaaaaaaaaaaaaaaaaaaaaaaaaaaaaaaaaaaaaaaaaaaaaaaaaa

SEQ ID NO: 3816 - DNA, 969 bp, Homo sapiens
catggtacggagcccgctctggcgggggcgccaaaagcaccaaagcggcgaatgggggccgctgtggccaaggattggggctaagtggaggagtctggcatggctcatgaatcagcagaggacttgtttcatttcaacgtagggggctggcatttctcagttcccagaagcaaactctctcagtttccagactccctgctgtggaaagaggcttcagccttgacctcttcagaaagccagaggctatttatcgacagagatggttccacatttaggcacgtgcactattacctctacacctccaaactctccttctccagttgtgcagaactgaacttgctgtatgagcaagcattgggtttgcagctgatgcctttgctgcagactctagataacctgaaggaagggaaacaccatctacgcgtacggcctgcagacctacctgttgctgagagagcatctctgaactactggcgtacatggaagtgtattagcaaaccctcagaatttccaattaaaagcccagcctttacaggcctacatgataaggcacctctggggctcatggacacacccctgttagacacagaagaggaggtgcactactgcttcctgcccctagacctggtggccaaatatcccagcctagtgactgaagacaacctgctgtggctggctgagacggtggccctcatcgagtgcgagtgcagcgagttccgcttcattgtgaattttcttcgctcacagaagattttactaccggataatttctccaacattgatgtattagaagcagaagtggaaattctggaaatccctgcactcactgaagccgtaaggtggtaccggatgaacatggggctgttcatcattccatttcccaactccacctccatggaagctactgtgcatgttatagggcgcaagctacctgagcatggcttcagccaccatcccgagaatgtgtag

SEQ ID NO: 3817 - DNA, 969 bp, Homo sapiens; identical to SEQ ID NO: 3816

SEQ ID NO: 3818 - DNA, 3056 bp, Homo sapiens
ctcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcactttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaaaaaaaaa

SEQ ID NO: 3819 - DNA, 5724 bp, Homo sapiens
atgcagagaacacagccccgcccctgttacctgaacgccccacagcagtgcccgggggctgagcggccggggcgtcccaccgccggcagccacagcttcctcctccgcccgggacctctggccggaagcagtccgttcgccttactagaccccctccaagcctttgagcagttcgtgtgggtccgctcccaagctagggctgggctgttgcgcttgcgccaggggtcgcatgcagtcacgcgctgccgaccgcttccggtgcgccgcgagggccgccgggacgggtctccctggcgatccgtggtgtgccgctactgccggtgcagccgccaaaccggtgcctcggtgacgaccgtgtccctgccgtcttcctcgagctccccggggcttgacccccggggccctcggcaggcatcggtgaggagcctgcggagcgaacctgtgctcctattcttgcccttcaggaccccatatcgcgactccgaggaggggaagcgagaggggctgtcgcgactccgcgccgtgtgtcgccgggcggggccgcggggccggggctccttcagcccccgggatgcgcgcgcgagccctcgcctccacttccttgttgctgctgtcacgactggagccgcctctcgccgacagcggggagcgcgagtgcgccagccatccccctcgtccagccgccgggccaagcgcctccgggaatgtgagcggcgcagcttgcacgctcctccggccatggacgcatcatatgatggtactgaggtaactgtcgtgatggaggaaattgaggaagcctattgttacacctctcctgggccacccaagaagaagaaaaagtataaaatacatggagaaaagacaaagaaacccaggtctgcttaccttctgtactattacgacatctacctgaaagtgcagcaggagctcccccacctccctcagtctgagatcaataagaagattagtgagagttggaggcttctcagcgtggccgagaggagttactacttggagaaagccaaactagagaaggaaggtttggatcctaactctaagctctctgcactgactgctgtggttccggacatcccaggtttccgcaagatcctcccacgctcagattatatcatcatccccaagagcagcctgcaggaggaccggagctgccctcagctagagctatgtgtggctcagaaccagatgtccccgaaaggacctcctcttgtgtccaacactgccccggagacagtgcccagccatgcaggcatggcagagcagtgcctggctgtggaggccctggctgaggaggtgggagcccttacccagtcaggtgctgtacaggagattgccacctcagagatcctcagccaggatgtgctcctagaggacgcttccctagaagtaggggagagccaccaaccttaccagacaagcctggtaattgaagagaccttggtgaatggctcaccagacctccccactggaagcctggctgtgccccacccccaggttggggagagtgtatcagtggtaacagtcatgagggattccagtgagagtagctcctctgcaccagccacacagttcatcatgttgcctctgcctgcctactcggttgtggagaaccccacctccatcaaactgaccactacatatacccgccggggccatgggacatgcaccagcccagggtgctcctttacatatgtcaccaggcacaagccacctaagtgccctacctgtggtaacttcctaggagggaagtggatcccaaaggaaaagccagccaaagtaaaagtggaattggcttctggcgtctcttccaaaggctctgtggtgaaaagaaatcagcaacctgtcaccactgagcaaaattcctctaaggaaaatgcctccaaactgactctggagaattcggaagctgtaagccagctcctgaacgtagctcctcccagagaagtaggtgaggagagtgagtgggaggaagtgatcatctccgatgcccatgttttggttaaggaagctcccgggaattgtggtacagcagtcactaagacgccagtcgtcaaaagtggtgtgcagcctgaggtcactctggggacaactgacaatgacagtcctggagcagacgtaccaacaccatccgaggggacaagtacctccagtccactccctgctcctaaaaaacctacaggagctgacctgcttacccctgggtccagagctccagagcttaaaggcagagcacggggcaagccctcattactggctgcagcaagacccatgagagcaattttgccagccccagttaacgtggggcgaggcagcagcatgggactgcccagggccaggcaggccttttccctgagtgataagactccctctgtgaggacttgtggtctgaagccaagcacactgaagcagctgggccagcccattcaacagccatctggccctggtgaggtgaagctaccaagtggcccatccaacaggacttctcaggtgaaagttgtggaggtcaagcccgatatgtttcctccatataagtacagctgcactgtcacattggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgaggtgagctcaccactcccagatgtactgaatgccacagagcccctgagcacagcccagagggagatccagcgccagtccacactgcagctgctgcgcaaagtcctgcagattcctgagaatgagtcagagctggctgaggtcttcgccttgattcatgaactcaacagctctcgacttatcttgtccaacgtgagtgaggagacagtcaccatcgagcaaacctcttggtcgaattattatgagtctccgtccacgcagtgccttctctgtagcagcccattattcaaagggggacaaaactccctggctgggccccaggagtgctggctgctgacagccagccgtctgcagacagtgactgcccaggtgaagatgtgtctgaacccccattgtctggccctgcacagcttcatagacatctacacaggtctctttaatgtggggaacaagctgctggtaagcctggacttgctttttgcaatcagaaatcagatcaagctcggagaggaccccagagtgtccatcaatgttgttctgaagtcggtgcaggagcagacagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgaagagaatgtgctagcactgaagagcgtggagttcacctggcctgaattcctgggctctaatgaggtaaatgtggaggacttttgggccacgatggagacagaggtgattgagcaggtggcatttcctgccagcatccctatcaccaaatttgatgcgtctgttattgcccccttcttcccaccactcatgagaggagctgtggtcgtcaacactgagaaagacaaaaacctggatgtgcagccagtacctggcagtggcagtgccttggtgaggctgctccaggagggcacctgcaagcttgatgagattggctcctacagtgaagagaagctgcagcacctgctaaggcagtgtggaatcccctttggggcagaagactccaaggaccagctctgcttctccttgttggccctctacgaatctgtacagaatggagctagagctatacggcccccacgtcacttcacaggtggtaaaatctacaaggtgtgcccccatcaggtggtctgcggctccaagtatcttgtgcgaggtgagagtgcccgtgaccatgtggacctgcttgcctcttcccgccactggccgcctgtctatgtggtagatatggccacgtcagtggccctgtgtgctgacctctgctacccagagctgactaaccagatgtgggggaggaaccagggctgtttctctagccccacagagccacctgtgagtgtgtcctgcccagagctcttggaccagcattatactgtggacatgacagaaactgagcactctatccagcacccagtcaccaagactgccacgcggcgcatcgtccatgcaggcctacagcccaatcctggtgaccccagtgctgggcaccactccttggccctgtgccctgaattggcaccttacgcaaccatcctggcctccatcgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccgccttggggttgctcagatcaagacagagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctggtagctggtgggttccgtggggcctgctgtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctttgaggaagagcatccccttcctcctttccctggccactgctgctgcagccaatatcctctctgggcctgggaccctctccacagaggggatgtggtccctggtcatgacataacctagcagcagtaggaaaaactcccttctatgaaggggaagcagactgggccataaggaaacagcaggactggctcaagtgcccaaggtttgtttagggcctgggaattggccatgtgttaatttattgagtggagtaggtggctttttttccctccctcttcccccaacaagaataaagtttattaaattatctggttttggtgtagcaggagtcaattccgtgcacatcgtatggggcacagtgtggtcaagctccacagctgtgagctcgtcacttcatgtgaaggagggaaggaaagaaagacgttccagggaatttgcaggtactcatgtggcacaaagaaccagaggctgactgcat

SEQ ID NO: 3820 - DNA, 7840 bp, Homo sapiens
cgcaggccagggccgcccggcgctcggcagccgcccgcagcccctcggagccagaggagaggcgcccccgccggccgccgcgccgcccggcagcctcggcaggtagtgtacactgataaaggtagggcgcggtggactctgcccctgtaaccgttccggagaatgcgttgagaatgaagacaaccagttctgccggagacttccatttggcctcaatgtgaaattaaagtagaaaatcacatctacatgcatgttgctatcaggatgttgattcattagtcatgcctgaagagggaaagtctgttttaggtggctgactaccagcaaaaataaatgcttatcctacatgtcaagcatctctactttttactggagtgaaaatcccctccagataccaacagaatatcaactgcagaaaatgcttcacattttaaggatgtcggcaacctaaattcatgtaccctatctgtacagttgttgtggatggtttgccatctgaaagctcctcaagttcttatccaggccctgtgtctgtttctgaaatgtctctgcttcatgctttgggtccagtgcagacctggctgggacaagagctcgagaaatgtggcattgatgccatgatttacactcggtatgtcctcagtcttctgctgcatgacagctatgactacgacctgcaggaacaggagaatgacatcttcctgggctgggaaaaaggagcttataagaaatggggaaagagtaagaaaaaatgttcagatctaactctagaagaaatgaaaaaacaggctgctgtccagtgtcttcgatctgcttctgatgaaagctctggtatcgagactttagtggaggagctctgctccagactgaaagaccttcagagtaagcaagaagagaagattcacaaaaagttagaggggtctccctctccagaggcagaattatcccctccagcaaaggatcaagtggaaatgtactatgaagcatttccaccactttctgagaaaccagtttgcctgcaagaaatcatgactgtgtggaacaagtctaaagtctgttcttactctagctcttcttcatcatccacagccccaccagctagcacagatacttcctctcctaaggactgcaacagtgaaagtgaagtcaccaaggaaagaagcagtgaagtacccaccactgtgcatgagaaaacccagagcaaaagcaaaaacgagaaggaaaacaaatttagtaatggcacaattgaagaaaagcctgctttgtacaaaaagcaaatccgacataaacctgaaggaaagattcgccctcgctcgtggtcttctggctccagtgaagcaggctcaagttccagtgggaatcagggagaattaaaagcatccatgaagtatgttaaagtaagacacaaggcacgagagattcgaaacaaaaaagggcggaatgggcaaagcaggctttctttgaagcacggtgaaaaggctgaaaggaacattcatactggaagtagtagcagtagcagcagtggttctgtcaaacagctgtgcaagcggggtaagagacctttaaaagaaatagggagaaaagatcctgggagcactgaaggaaaagacctgtacatggagaatagaaaggacacagagtataaagaggagcccttgtggtacaccgagccaattgctgaatattttgttcctctgagcagaaaaagtaaactagagaccacataccgaaacagacaggatacaagtgatctgacatcagaggcagtggaagaattgtctgaatcagtgcatggtctttgtatcagcaacaataatcttcataaaacatacctcgcagcaggtactttcattgatggtcattttgtagaaatgcctgcagttataaatgaggatattgacctcactgggacctcattatgttctctaccagaggacaataaatacctggatgatattcatctatcagaattaacgcacttctatgaagtggatattgatcaatccatgttggatcctggtgcctcagaaacaatgcaaggagaaagtcggattttgaaaatgattcgacagaaaagcaaagagaacacagattttgaggcagaatgttgcatagtgttagatggtatggagttgcaaggggaacgtgcaatatggacagattctaccagctccgtaggtgctgagggcttattcctgcaggaccttggcaatctggctcagttttgggagtgctgttcatccagctccggtgatgctgatggggagagttttggaggagactctccagttagactctctcccatcttagacagcacagtgctcaattcacacctgcttgctggcaatcaagagctcttttcagatattaatgaaggatctggtataaactcttgtttttcagtgtttgaagtgcaatgcagtaattctgttttaccattttcttttgaaacactcaacttgggaaatgaaaatacagattctagtgctaatatgcttgggaaaacacagtctagattgctaatatggaccaaaaatagtgcctttgaagaaaatgaacactgttctaatctttcaacaagaacttgtagtccatggtcccattcagaagaaacacgttcagacaatgaaacattaaatattcagtttgaagaatccacacagtttaatgccgaagatattaattatgtagttcctagagtctcgtcaaattatgtagatgaagaacttctagattttttgcaagatgaaacttgccagcaaaacagtagaactttaggtgagattcctacattagttttcaaaaaaacatctaaactagaatccgtctgtggtattcagctagaacaaaaaacagaaaacaaaaattttgaaactacacaagtatgtaatgaaagtccacatggagatggctacagctcaggggttattaaagacatttggacaaagatggcagacacaaattctgtggctacagtagaaatagaaagaactgatgctgagttgttttcggcagatgtaaataactactgctgctgtctagatgctgaagctgaactggagacccttcaggagcctgataaggctgtgcggaggtcagagtaccatctgtgggagggacagaaagagagcctggagaaaagagcatttgcttctagtgagctatcaaacgtggatggtggtgattatacaacaccctctaaaccctgggatgtagcccaagataaagaaaacacattcattcttggaggagtttatggagaactcaaaaccttcaatagtgatggggagtgggcagtcgtaccacctagtcacacaaaaggaagtctgttacagtgtgcagcttctgatgttgtgacgatagctggtacagatgtctttatgaccccaggaaacagttttgctcctgggcacaggcagttatggaaacccttcgtgtcatttgaacagaatgatcagccgaagagtggggaaaatgggttaaataagggattttcttttatcttccatgaagacttactaggagcttgtggcaactttcaagtcgaagatcctggacttgaatactcattttcttcctttgacttaagcaatccattttcacaagttcttcatgtagaatgctcatttgaacctgaagggattgcatctttcagccccagttttaaaccgaaatcaatcctctgttctgattcagacagtgaagtgtttcaccccaggatatgtggtgttgacagaacacaatacagggctattcggatctctcctcggactcactttcgcccaatttctgcatccgaactgtccccaggaggaggaagcgagtcagaatttgaatctgagaaagatgaagcaaatattcccattccttctcaagttgatatatttgaagatccgcaggcagatctcaaacctttggaagaagatgcagagaaagaaggccattactatggaaaatcagagcttgagtctggaaaattccttcccaggttaaaaaaatctgggatggaaaagagtgctcagacatcactggattcccaggaggaatcaactgggattctttcagtaggaaagcaaaatcagtgtttggaatgtagcatgaatgaatccctggaaatagatttagaaagctcagaagcaaattgtaaaataatggcacaatgcgaggaagaaattaataatttttgtggttgcaaagcaggttgtcagtttcctgcttatgaagataatccagtttcttcgggacagctggaagagttccctgtattgaacactgatatacaaggaatgaatagaagtcaagaaaaacagacctggtgggaaaaagccttgtactctcctctttttcctgcatcagagtgtgaagaatgttacacaaatgccaagggagagagtggtttagaagaatatccagatgctaaagagacacccagtaatgaagagcgcctgttagattttaatagggtgtcttctgtttatgaagcaagatgtacaggagagagagattctggagcaaagtcagatggcttccgcggaaagatgtgctccagcgccagctccacctcggaagagacaggctcagaaggcggaggcgagtgggtgggccctagtgaagaggagctcttttctcgaactcatctctaaacctgcaaaatagtacaaattattgtttaaaaatgatatgtgatggaaaattactcttcagtgagacctgttaatctaaaacaacaacttaggtttcctcttcaattaactgattcagattggtaataattatctttctcttcttgcttattttagagttgaggacagctatcctgttaaagattttttttcccagctgttaaattcttggctatttgaaatagactagattgtgttgtcaaatcaagaatgggtgtgcatgtgcttgtcttagaagtatcactgctttttgcatcttaactgcagttaattttccttccgactgcggttatatcactatgaccttactagcattgcagtgtcaacaaccacttctgctcttcagagacttcagctttggagcatttaggctttgttctccaagaactgggatatccattcttaccctacagtggcttgatgcctttctgaaggcgagagggaagcctgggtgactcagcggtggtctccattcagcaaaatctcatgtacatttccagtaggaaccgcagaggtgtgcttttcaagactcaccaaatactgtgttttctctcttaggatttcttttcccctaaagtatcacggaagatactatggttcgtgactttcttgctaactgaagaagccaaggatttggggtgtggggtcgtatgcgagacacagtggggtaagggtgcataccccaccccttacctgctctcatactgcagttacatttacaccaaaaccccatgcagggttctttgtggtgagtgttccatacgtgctaaggaccttagttgcagattgttactttctggtgacctatgttgaattgaaacccccaaaacttgaaattgtgaacatttgacatgcagtaaaggccacctcatcacccagagaaatctttggctgctgcagctagccgcttcttggctgtgatgtagtatagcttcgatctcattttgtgtttgagagaatgttctgggcaagttctgtgtgtggtgggttggggcgggtagagtcatgagttttccacatccctgtgtggtggttttgctgactgtcgctccgtgggactggctcccgtttctccttggtgagcccggggagccggcgcatcttgtgagtcgcgtctgtgcatggcgatccgctcctccggctctcatggcattgtgccacaggcagaggccaggaggagcagtatgtgcacagccgaaacattttacattttttacattgtttttcttttttaaccaactcattgtttaaaaaacaaaaacaaaaaaaacctaatctgtgaaatcagcgtagcatgcctggagcatcaggaatggcagaaaagtctgatgcgctctagacagcttcaccactcatttgggcaggcagtaaacacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacatcttttgacactttaaggtgggtgggtgtgggtgtgtgtgtgtgtgtgcgcgcgtgcgcgcgcgcatgtgtaaggttttatgttgctgttatttatttacgaacttcagatacgtttttatgtatttttcattcttctggagcttcctaaaaattgataagcatctgcactgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggagttaacaccaaataaaaattgtaaaaaacagtttgttgtttttatttctcatagcaaagcttcttttgtaaagaactccagcttccttttactcatgagcatccgtggaagagcaagtgcccaggttacatttgttctagatggaggtcatttagctctcattgcagacactgctgaaaacattgtgcagctttgctagggaagaaagtggtgtggcctgctgagaaatcagcggctcctccccatctcacccccagcacacgcagggactactacctgagtctgcaaaacacatagcatttttgtccgtggatggtacacaaagctcaatctttttgttttcttctggggaaaaaattaaatctttatatgttaatatgattgatattcattgtgcaaaaaaaatcagtgtgtttttaaagaagtataagggaaaaggaaaactcatatgtccttctgtcactctgagacatacactggtaacatctgtgcaagcccctttccaggattctgaatgtacagtatatatgaatgcatacacagagaaatttacattcaagagtgtactatacttgttcttctataacatcagaaataggtttttactcagatgtcttcatgtcggtaattatagaactacataattatttttatagctgtattatgtagatttaacaggttcctcattgataaaacaatgtttttttggttgtttattcagtatctgaataacgtttctatggacatctgtaaacatgtatgaggggacttttaaaagttcatggaaaatggaattaaaagaaaaataaaaaaatataaacttt

SEQ ID NO: 3821 - DNA, 2353 bp, Homo sapiens
gctttgcctccaccgatctccctgtggggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacgctgcaattagacaatgaaaagatattatcggactatgggacaacttttgttacagcatggaagaatactcacaactacagggtgtggaacagcaacaagcatccagcacttgcagaaataaatccaaaccatccatttcaaggccaatactcagtatcagacatgaagttaaggttctcacattctgttcagaatagtgaacgtggcaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttc

SEQ ID NO: 3822 - DNA, 11690 bp, Homo sapiens
gaattgtctatttcacagcaatattaccagtgacttgaaagcatttacagacaagtttggttttgatgtcctcatcctgttctccagctatctgtcagaggagcagcagccgagacgacagattgctgtgtactcagaaaacatggagctgtgcagtcagatttgctgtgagctggaagagtgtcagaacccttgcctagaactggagccctttgactgtggctgtgatgagatcctggtgtaccaacaagaggacccttcagtgacttgtgatcaggtggttctcgttgtcaaggaagtcatcaacaggaggtgtccagagatggtctccaatagccggacatcctcaacagaagccgtggcaggcagtgcccccctctcccaggggtcttctgggattatggaattgtatggttctgacatagagccacaacccagctctgtgaatttcatagagaaccctccagatctcaatgattctaaccaggctcaggtggatgccaatgtagaccttgttagcccagacagcggactggctaccattaggagcagccgctcatccaaggagagctctgttttcctcagtgacgacagccccgtgggagaaggtgctgggcctcaccacacccttctcccagggcttgactcctacagccccatccctgaaggggcggtggcggaggaacatgcatggtctggagaacacggtgagcacttcgacctcttcaattttgacccagcacccatggcttctgggcagtcccagcaatcttctcattctgcagactactccccagcagatgacttcttccccaacagtgacctgtcagaaggacagctccccgctgggcctgaaggacttgatggcatgggaaccaacatgtctaattattcatccagttcacttttgtcaggggctggcaaagatagccttgtggaacatgatgaggagtttgtccagagacaagacagtcccagagataactctgaaagaaatttgagcctgacagattttgtgggagatgaatccccttccccagaaaggctaaaaaatactggaaagaggatcccaccaacacccatgaatagtttagtagaaagctcgccatccactgaagaaccagcctcactctatacagaagatatgacccaaaaagcaactgacacaggtcacatggggccacctcagacccatgcacggtgcagcagctggtggggtggtttggaaattgactccaaaaatattgcagatgcgtggagttccagtgaacaggaatctgttttccagagccctgaatcatggaaagagcataagccaagctccattgataggagagcctcagattctgtatttcaaccaaagagcctcgaatttacaaagtcaggtccctgggagtctgaatttggtcagcctgaactgggtagcaatgatattcaagacaaaaatgaggaaagcttgccgttccagaacctgcccatggagaagtcacctttgccaaatacatctccccaaggaacaaaccacctgatagaagactttgcttctttgtggcattctggtcgctctcccacagccatgcccgagccctggggaaatcctacagatgatggtgaaccagcagctgtggcgccattcccagcctggagtgcatttggtaaagaagatcatgatgaagctttaaaaaatacctggaatttgcacccaacaagcagcaagacaccttctgttagggacccgaatgagtgggccatggcaaaaagtgggtttgccttttcttcttcagaactactggacaattcacccagtgagataaacaatgaagcagctccagaaatctggggcaagaaaaacaatgactccagggatcacatctttgcacctggaaatcccagttctgatctggatcacacatggactaattctaagccaccaaaagaagatcagaatggtttagtggatcctaaaactaggggcaaggtatatgaaaaggtagattcctggaacctttttgaggagaatatgaagaaaggagggtcagatgtcctagttccttgggaagattccttcttatcttacaaatgttctgattacagtgcatccaacctaggagaagattcggtgccttcccccttagataccaattattccacctcagactcttacacatcaccaacatttgctggagacgaaaaggaaactgaacacaagccatttgctaaagaggaaggttttgagtcaaaagatggtaactccacggcagaggagactgacattcctcctcagtcactgcaacagtcatctcgaaatcgaatcagttcaggtcctgggaacctagacatgtgggcttcacctcatacagataacagttctgaaataaataccactcacaacctggatgaaaatgaactcaagacagagcacacagatggtaagaatatctccatggaggatgacgtcggggaaagcagccagtccagttacgacgaccccagcatgatgcaactgtacaatgaaacaaaccgacaactcacacttttgcacagcagcaccaactcccggcagacggcccctgacagtctcgacttgtggaacagagtgattttggaggatactcagtccactgcaacgatctcagatatggacaatgatttggactgggatgactgcagtgggggtgcggcaatccccagtgatggtcaaacagaaggatacatggctgaaggttccgagccggaaacccgatttacagtgagacagctggaaccctggggcttggagtatcaggaagcaaatcaggtagattgggagctccctgcctctgatgagcataccaaggacagtgctcccagtgaacatcacacattgaatgagaaaagtgggcagctaattgcaaacagtatttgggattctgtcatgagagataaagacatgtcatcattcatgttaccaggctcctcacatatcacagattcagagcaaagggaattgcctcctgaaatccccagccattcagcaaatgttaaagacactcattccccagatgcgccagcagcctctggaaccagtgaatcagaggcacttatatctcatcttgacaagcaggacacagagagggaaaccctgcaaagtgatgcagcatccttggcgactaggcttgagaatccagggtattttccacacccagatccatggaaaggtcatggcgatggacaaagtgaaagtgagaaggaagcccagggagccactgacagggggcaccttgatgaagaggaggtgatcgcctctggtgtggagaatgcctcagggatttctgaaaaagggcagagtgaccaggaactgtcttctctggttgcatctgaacatcaggaaatctgcattaaatcaggcaaaatcagctctcttgctgtcactttcagtcctcaaaccgaggaaccagaggaagttttagagtatgaggaggggtcttacaatctagactcccgtgatgtgcaaacagggatgtccgcagataacctgcagccaaaagatacccatgaaaaacacctcatgagtcaaagaaattcaggtgaaactactgagacttcagatgggatgaatttcacaaaatatgtatctgtacctgaaaaggatcttgagaaaactgaagaatgtaactttctagagccagagaacgtgggtggagggccacctcacagagttccccgaagtcttgattttggggacgtccctatagacagtgatgtgcatgtcagcagcacatgttctgagataaccaaaaatcttgacgttaaggggtctgaaaatagccttccaggagccggttcgtctggaaattttgacagagatactatttctagtgagtatactcattcaagtgcatcaagtcctgagttaaatgactcttcagttgcactgtcctcctggggccagcaacccagttctgggtatcaagaagaaaaccaaggcaactggagtgaacagaatcaccaagaatctgaactaattaccactgatggccaagtagaaatagttaccaaagtgaaggatttagagaaaaacagaataaatgagtttgaaaagagctttgatcgcaaaactcctacatttttagagatctggaatgactcagttgatggtgattccttttcctctttatccagtcctgaaacaggcaaatattctgaacattcagggacacatcaggaaagcaatctaattgctagctaccaggagaaaaatgaacatgacatttctgcaactgtgcaatcagaggatgccagggtcatttcaacaagctcaggttctgatgatgacagtgtcggtggtgaagagtcaatagaggaagagatccaggtggccaactgccacgttgctgaggatgaatccagagcttgggattcattgaatgaatctaataagttcttggtcacagctgatcctaagtctgaaaatatttatgactacctagacagctcagagccagcagagaatgagaataagtcaaacccattctgtgacaatcaacaaagcagccctgatccctggactttctcaccattaacggagactgaaatgcagattacagcagtggagaaggagaagagatcttctccagaaacagggacaacaggagatgttgcatggcaaatatctcccaaagcttcgttcccaaagaacgaagataattctcaactggaaatgctgggcttctcagctgatagcactgagtggtggaaggcctcaccccaggaagggagactaattgaaagtccatttgaaagggagctgtctgactccagtggtgtgttggagataaattcttcagtacaccaaaatgccagtccctggggagtaccagttcagggtgatattgagcccgtggaaacacactatactaatccttttagtgacaaccatcagtcaccctttctggaaggtaatgggaagaactcccatgagcaactctggaacattcaaccaaggcagccagacccagatgctgacaagttcagccagcttgtaaaattagaccaaattaaagaaaaggactcaagagagcaaacctttgtgtctgctgctggtgatgagctgactcctgaaacacctacccaagagcagtgtcaggacaccatgctgccagtctgtgatcatccggacacagcctttactcacgcagaggaaaatagttgtgttacatctaatgtttcaactaatgaaggtcaagaaacaaatcagtgggaacaagaaaaatcatacctaggtgagatgacaaattcaagcattgccacagaaaattttcctgctgtcagttctcccacccaactgataatgaagccaggctctgaatgggatggctctaccccaagtgaggactcccgaggtacctttgtgccagatattttacatggcaactttcaagagggtgggcagctggcctctgccgcgcctgacttgtggatagatgctaagaagcccttcagtttgaaagcagatggtgagaatcctgatatcctgacgcactgcgaacatgacagcaattctcaggcttccgacagccctgatatatgtcacgattctgaagcaaagcaagagactgagaagcacctcagtgcttgcatgggacctgaagtggaatccagtgagctttgtctcactgagccagagatagatgaagaacccatttatgagcctggacgggagtttgtcccatccaatgcagaactcgattctgaaaacgcaactgtgctgcctccaattggctatcaagcagacataaagggctcctctcagcccgcctctcataaaggttcacctgaaccttctgaaataaacggtgacaacagtacaggtttacaagtatcagaaaaaggagccagcccagatatggcaccaattttggaaccagttgacagaagaatcccaaggattgaaaatgtggcaactagcatttttgtaactcaccaagagccaactccagaaggtgacggttcttggatatcagacagcttttctcctgaaagtcagcctggtgcaagagctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaataccagaattggaagaagaaaaaacaattcctaccaaagagcctgagcagataaaatcagaatacaaggaagaaagatgcacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaggcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttagcactagaggaagcctctggtccagtcagccaatcacagaagagtaagagccgaggcagggctggcccggatgcagttacccatgacagtgaatgggaaatgctttcaccacagcctgttcagaaaaacatgatctctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaaactggatgaagaactgagggaagcatcagaggcagctaaaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatagtcttcatatgccctttaaaatgccaacaagatttcaagtctgtaggcctctagtgaggtggggtggcaaaccacagctaagtctcgctcaccactgcaagctaagaatggtttttacattttgggttggaaaaattttttttgaatatttcatgacacatgaaaattattcaaatgttagtgccgataaataaagtggtactgaaacacagccacacaaacttgtttttgtactgtctacagctactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttggtaaataaattctccataatgtagattaataatataaaagtctttaatgacacaatatatctatatagcctcactgtataattcagaaataaaaattgattctgc

SEQ ID NO: 3823 - DNA, 2953 bp, Homo sapiens
gagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaagaaaaaaaaaaaaaaa

SEQ ID NO: 3824 - DNA, 3096 bp, Homo sapiens
gagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaagaaaaaaaaaaaaaaa

SEQ ID NO: 3825 - DNA, 3421 bp, Homo sapiens
gagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaagaaaaaaaaaaaaaaa

SEQ ID NO: 3826 - DNA, 5659 bp, Homo sapiens
gtcggctccgagagctctggcttatcaggactccatagttctccaacagagaaatcttgaaaaggactgaccagtttttgcagttctaaaaccatggcccatggttcagtgacattcagggatgtggccatagacttctcacaggaagaatgggaattcctggatcctgctcagagggacttatatagggatgtaatgtgggagaactacagcaacttcatttcactaggaccttccatttctaaaccagatgtgattaccttattggatgaagaaaggaaggaacctgggatggttgtgagggaagggacaagaagatactgccctgatttggagtccagatacaggaccaatactttatctccagaaaaggacatttatgaaatatattcatttcagtgggatataatggaaagaattaaaagctatagccttcagggttccatttttaggaatgattgggaatgcaaaagcaagattgagggggaaaaggaacaacaagagggatattttgggcaagtgaaaattacctctgaaaaaatgaccacttacaaaaggcacaattttcttactgagtatcagatcgttcataatggagaaaaggtgtatgagtgtaaggagtgtaggaagacctttattcgtcgctcaacacttagtcaacacctgagaattcatactggtgagaaaccttataagtgtaaggaatgtgggcaggcctttagacagcgtgcacatcttattcgacatcacaaacttcacaccggtgagaaaccctatgaatgtaaggagtgtgggaaggcctttacagtgctccaagaacttactcaacatcagagacttcatacgggtgaaaaaccctatgaatgtaaggaatgtggaaaggcctttagagtacatcagcaactggctcgacatcagagaattcacactggtgagaaaccctatgaatgtaaggactgtggaaagacctttagacagtgtacacaccttacacgccatcagagacttcatactgctgaaaagctctatgaatgtaaggaatgtgggaaagccttcgtatgtggtccagaccttagagtacatcagaaaattcattttggtgagaaaccctatgaatgtaaggagtgtggaaaggcttttagaatatgccaacaacttactgttcatcagagtattcatactggtgagaaaccctacgaatgtaaggaatgtgggaagacttttagattaagacaacaactagttcgccatcagagaatacatactcgtgagaaaccctatgaatgtatggaatgttggaagacctttagtagttactcacagcttatttcacaccagagcattcatattggtgagagaccctatgaatgtgaagagtgtggaaaggcctttagactgctctcacaacttactcagcatcaaagtattcacactggtgagaaaccttatgaatgtaaggaatgtagaaaaccttttagactgctctcacaacttacccaacatcagagtattcacactggtgagaaaccttatgaatgtaaggaatgtggtaaggcttttagactttattcatttcttactcaacaccagagaattcatactggtgagaagccctacaagtgtaaggagtgtaagaaggcctttagacagcattcacaccttactcagcatcagaagattcataatggaatttaatagaagaaagccttcaaatgtatatgatgttacagaacatcagaaaattcatttttgagaaaatgtgtttcatgctcaattccaagcataataaattttatattagagaaagaatatgttgatttaaaagccttccaacaccatttaaacatggtttatcttcagcaaattcctatgagagaataatgtaatgaatgtaggaaaatctttagccttatctgtcattatctccctttctccacttgattaccagtttgatttattggacaagatactaagcttctgtgcctcattttgctgacttgtaaaatggtaataatagtacttatatgtattagttatttattgctgcgtaataaattaccacagacttagtagcataaaataacatataattatatcttataatttggatcaggagtataggcatgacttagttgggtcctctgcttcagggtctcttgcaaggctacagatttcagccagggctgaggtctcatctgaaggctcaactggggaaggatccacatccagactaacatagttgttacccaatgtatttccgtgaggcctgttgcattgagattctcagtttctagctggctgttggctgaacgctgactgcagctcctggccacaatagcctcatcaacatggctgcttgcttcatcaaggcatgcaagccaaaagggaggacagtctgctagcaagatggaagttaccatcttgtgtaatctaatcatggaagtaacattccctcaccttctactggtagaagtaagttactaggatagtccacactcaagagaacgggatgatacaagagtgtgaataagtcctggagacaggaccactggggggcctgtttagagtcagcctgccacactgtggaataggattgttgcaaggagtaagtagttaatacttggaggaatcacagtcatatagcatgtattctgtaaatattatctgtaattgttattattgtcattagtattagtgaattcacgtaaaaggaagatctgtagacataataaatgtagaaatgcctcctgtcacctctcagaaattattaaacataatttattctaggtaaaatttagattgtagtgaatgtaggaagttcttcagcacttgagctgcattagaaatttcatgccaaaaatgaatttcatgaatgtgaggtcactagtaatacagctgttgaagaattagagggaaataggaaatgattttcccataattccagaaagcaaaaggcttacaatccctgttgtctgaccacagtttaaaattaattagaaactatcaaaaatgtggcttaaaagaaattaaccacctaggaatttaatattgttgtgtatatttatgtgtgtgtataaaactcctgtgggaaagaaacaaaacatcattctataagtcagtatacttttggatgctcaaaatgccatatcttcaaccagtaggagttgtttcaagttgagtttttgatgtgatcccaccaataatttgatagtttacttgattgtggctgcataatttggtaacctatgaaagatgctagagcaccaatgtataatttttttgagacagggtgtcactttgtcccccaggctggagtgcagtggtacgagcacagttcactgtaccctgttcctcctgggctcaagtgattcttccacctaaattttttttttttttttagagaaagggtctcactatgttgcccaggctggtcttgaacttctgggctcaagtgatcctccctccttggcctccaaaggtgctggggttacaggtgtgagccaccacacccggcccaactcattattcttgaaatcaataaatcagaggaaaaattgtcatttagtttccttttcccatgtgaaccaaatttcagggtcaccagaagttcatcaaattcaaatgaatttggcctggcacaggggtcacacctgtaatcccagcactttgggaggacaaggtgggtggatcacttgaggccaggagtttgagaccaacctggttaacatggtgaaaccctgtctgtactaaaaatacaaaatttagccgggcgtggtggcacacacctgtagtcccaggctgaggtgggaggatcacttgagcccaggaggcagagtttgcagtgagctgggatcgtgccactgcactccagcctgggtgacggagtgagaccctgtctcaaaaaaaaaatttgttttttgaatgggtttttcttttttgaagaagtctaataaatctagaaggaattagaggattagaaaaatcaccattttctggaccttaatggaataatgggtccagaaaacatgatcttcaatgggtactacaactaataggtgaaatattttatagcgagatttttatggtggatctatcaaactggccacctctgaaccctttgatctgttttaaccttaataaaaatgggtctatcagacaacacacttcctgacgtaatgcaataggaagtccacaccaccatctacaaagccttattgctggaataatgaactgaaagcagacagggactagatgaacagtatatggtcatcccttggtatccatggggaattggttccaggatcctccactgatggtaaaatctgaggatgctcaagtcccttgtataaaatggcatagtatgtatttgcatattacctactcacatcttcctgtatactttaaattatctttagatcacttatacctatcacaatgtaaatactatgtaaatagttgttatactgtatttttcaatttgcattatttttattgtattttatttttattgtttttttttgagtattttctatttgagattggttgaatctgcacatatggagggctggctataaagggcaccacaaggaagaagccaaacagatccagaatgtgtgaaattctacagagcaaattacctgatttcttcaactaacaggtagcatgaaaatacaaggggaagggcaaccattaacagattaaaagagacttaaagagacatatcaactaaattcagtatgttggcattacttggacctggtttgaacaaaacataaaaagccattttggagacagtgagggaagtgtggacatggactaaatattaaatgatatttacatatattaatttggttagggattatgtcagtgtgattataaaaaataaaagatcgtatgatatgagatacatactatgaaatgaagatagacacatttggattaaaatattctagcaaaagaaataattggcaaagagagctggaaactaaattggcaacatgttgataatttaagtggagtgttttgttcatggagacttattgttctaatatttctacttttgtatgtgtttgaaatttcaataataaaatgtttaaaatcaaaaccaaaattatagactatgtagaaatgaatgacagtgagatgcctgcacatctaaccttgtcagatataatcaaagttctgttcagtgacaaattaatgccctgtaatgtggtaaggaaatcttatttgtggatacagtcttcatcttcttcacttacccacagcagcaacaccaggcctgtcacacagatgaatgtgttgagggaatgaataagtatttccgtcaagaaaaaggaaacaacaaaataaaaccaacccaagtaaagaacagccaagtggccaggtgcggtggctcatgcctgtaatcccagcactttgggaggccatggcaggtggatcacctgaggtcgggattttgagaccagcctgaccaacactgagaaaccccatctctattaaagatacaaaattagccaggcatggtggtgcatgcctgtaatcccagctacttgggaggctaaggcaggagaatcacttgaatccaggaggcggagtttgtggtgagttgagatcgcgccactgcactccagcctgggtaacagagcaagagtctgtc

SEQ ID NO: 3827 - DNA, 5820 bp, Homo sapiens
ctggggaggggctcctttgcctgctcagttggggaagggacagactcataaactcaagtgcagtgagatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggcgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacaggtacccagctcagactccaggcttaggggtccctctggaatgatgctccccctggaatgatgctccccgagccctccacccggctctgcaccccgactttctgcatgagttcccatggctgtaggccacgtgggacagaaagtgacatggagccaggccccagtctctcaggtacccacggggacctctcctctccaggcgttttgggatcctcactggctccggtgggccctgcacagcacccccacagggaagctgctgtttctgccttcctctaaggtcccaaaactgcctggctgctctgttggccccaggctccagcacacactggaggctgcccctcaccctgtgtcttggttccggctactccaagccttgtcctctgcagggcatccactgctgcctgtgagcagacccctgggaactgcctgatctgagccccctcaggagcccaaggacaaccttgtctgtaccatacatcactatgtcttcccaagctcacacctcccagctcccagcaaagggcagggcgtgtctaccacccaccagcccactggggtcccccttcctcgccgaggcctccggagcatgggtctgctggcccttcctttctttgccatcttagtcatggacagaggctggcccaggggcacctggcttcctgtgacctccgggagactccatgctgggcaaggcagagtgacccttcccctggcaggcgggggcatgaggctgccacggggaacacaggtttccttgcacctggccctttaccctgtcagctttgctgttttcatgtgctctgacgccctcccattaggtgcatccaagctgcaatgcccacttcctcctggcaggggggacccgcaggcaccttctgctcagaggtgcacttgtctggtggccctgctccttcctggtactgttgacctttctgtgtgtttgttttaaatctcttgcatggtaaatagctgcattttgttactgataagagtgagtttaaatccactgtcatatcttttgcgtctttgttacacattttgttttttaaaaatcttctttcttgtccttttttagattgacagtgtccctcttacctcactttctccactcagtttgtaatcctgcagtctgttgcttttcttttagcgtttgccctaaaggtggctgcatgtgtcctcactgaagtccagcatgggccccaaatgcaggctgaggtctgggtctggctgggctgctgggcgcccgagtcatcatgaccattgttcctgggcacagccggcgttgacttgtatttcctccgtgattaccgcctggctcatcaatcactgttttcgttttccgtggaggcgtggctcacacaaagggcaagcacggagtcactgggtcctgcaggactttccaggtcaaggcagaggaggtgtccggtccccagcaggctcctgtgtgcccctcagtcccctagagggtcacggccacctgaccgccaccactagaggttttggcgattgtgctgtgtggtgggtcttcccggcctctgcttagcacagcagtgctgctgcccatccttcctccttgccaggtagtgccgggtgctgctgcccatccttcctctgccgggcagtgccgggtgctgctgcccatcctttctccttgccgggtagtgccgggtgctgctgcccatcctttctccttgccggacagtgctgggtgccgtgtgggctgcactgtgtgtgtgtttctaggtgatggacattcagattgttttttggtttggggctgctggggatggcgatgctttgaatgttcctgggagtgtctgttggtgggtagagcatgcatttctctttcgtgtgtatataggagtggaatcaaggccgggcactgtggctcatacctgtaatcccagcagtgtgggaggctgaggcaggaggattacctgaggtcagaagtttgcgaccagcctggccaacatggcaaaaccccgtctctactgaaaatataaaaattggccaggcatggccaggcgcagtggctcacccctgtaatcccagcactttgggaggctgaggtgggtggatcacgaggtcaggagatcgagaccatcctggctaacatggtaaaaccccgtctctactaaaaatataaaaaattagccaggcgaggtggcaggcgcctgtagtcccagctactcgggaggctgaggcaggagaatggtgtgaacccaggaggcggagcttgcagtgagttgagattgcaccactgcactccagcctgggcgacagagcaagaactc

SEQ ID NO: 3828 - DNA, 1623 bp, Homo sapiens
gcgaacattaggttaaaacagagatcctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctggtgagtgcctccatgctagcctggccgccacccctggccatgtccaggatggagcaggtcctggcagattgtgtccctctaagtgaaagcaccatcctgctttgaattctctagaaagatttccctacttactattttgcaaaattctaaactttttgaaaagttgcaagggtggtacctttctacccttcgccatatgatggtggctcacacttgctttgacagctggctgcagacaccatgcgtggccacactccccaggtgaccatgcctctgagggttcccagagcctaagacagccatccctgagcccactgctctagctcattctgggatctattcaaagacacactttggtttagtttggttgtctcttagacttgtttgcccaagaggagcctttttactctttttaagagatgaggagaccaattgtttcgtagaatgtccctcaatttacatatgtgtgacggtttcttcgcaattagactaaaaaaattcacgtttccttgttttaaggctaattttttttttttttagtggtcttgctctgtcgccaggctggagttgcagtgagctgagatggctaaaccgcactcaagcctggacaacagagtgagactc

SEQ ID NO: 3829 - DNA, 443 bp, Homo sapiens
gcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagctggcgcccaagtagataccaggtttccatctgagcccaggatcctgtgcaagggccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgcc

SEQ ID NO: 3830 - DNA, 1651 bp, Homo sapiens
tgggggtgccccccttccctcaacctctggcatcgccttcctcctagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgtgaccgtggagagcgcggacctgcagggctgctgctttgctgggcctggcagcccccacccgtaaggcccccacccgtcggggtgtttcctggcccgggtcaggcaagggcacccatcaatggcagggggctaggcaggcaggcctgcaggggcacagcctgtgaggagacgtatgctgcatgtccttcccaggagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtg

SEQ ID NO: 3831 - DNA, 3666 bp, Homo sapiens
tctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaagattcaggtggtgccgtgcacggctgggtcacacctctgctgtcactgactggctctggcccttcttctgggaggatttcaggagtttctgagccgaggattcccgtcggggagtgtaattgtgtaactgaagtcccgctggttcctctggcctctcaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgaggattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccggtaagcaccaccccctgccccacccccacgccgcccggcagccccgcctgatgcccccacttcacagggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcc

SEQ ID NO: 3832 - DNA, 834 bp, Homo sapiens
ccccacccgtaaggcccccacccgtcggggtgtttcctggcccgggtcaggcaagggcacccatcaatggcagggggctaggcaggcaggcctgcaggggcacagcctgtgaggagacgtatgctgcatgtccttcccaggagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccggtaagcaccaccccctgccccacccccacgccgcccggcagccccgcctgatgcccccacttcacagggttcctggtgctgcactcggagcccaggcagcagccgcaggtggacctggaccagctcattgcgggtgagcacccctccacggggcccctccgctgggccctgctgaccctgtaggcacccgcagggactaagtgattttcctggatttcaggactttttccctgtcactggtgacctcatcgtctctagtaattcacggaaacttcttaactgttccaaaagagcttaaaa

SEQ ID NO: 3833 - DNA, 2058 bp, Homo sapiens
tgggggtgccccccttccctcaacctctggcatcgccttcctcctagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcccccctcctctacccccagcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctccc

SEQ ID NO: 3834 - DNA, 880 bp, Homo sapiens
ccccacccgtaaggcccccacccgtcggggtgtttcctggcccgggtcaggcaagggcacccatcaatggcagggggctaggcaggcaggcctgcaggggcacagcctgtgaggagacgtatgctgcatgtccttcccaggagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcgagtga

SEQ ID NO: 3835 - DNA, 1476 bp, Homo sapiens
ccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagcggccccctttcccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcgagtga

SEQ ID NO: 3836 - DNA, 2047 bp, Homo sapiens
tgggggtgccccccttccctcaacctctggcatcgccttcctcctagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcgagtga

SEQ ID NO: 3837 - DNA, 5820 bp, Homo sapiens
ctggggaggggctcctttgcctgctcagttggggaagggacagactcataaactcaagtgcagtgagatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggtgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacaggtacccagctcagactccaggcttaggggtccctctggaatgatgctccccctggaatgatgctccccgagccctccacccggctctgcaccccgactttctgcatgagttcccatggctgtaggccacgtgggacagaaagtgacatggagccaggccccagtctctcaggtacccacggggacctctcctctccaggcgttttgggatcctcactggctccggtgggccctgcacagcacccccacagggaagctgctgtttctgccttcctctaaggtcccaaaactgcctggctgctctgttggccccaggctccagcacacactggaggctgcccctcaccctgtgtcttggttccggctactccaagccttgtcctctgcagggcatccactgctgcctgtgagcagacccctgggaactgcctgatctgagccccctcaggagcccaaggacaaccttgtctgtaccatacatcactatgtcttcccaagctcacacctcccagctcccagcaaagggcagggcgtgtctaccacccaccagcccactggggtcccccttcctcgccgaggcctccggagcatgggtctgctggcccttcctttctttgccatcttagtcatggacagaggctggcccaggggcacctggcttcctgtgacctccgggagactccatgctgggcaaggcagagtgacccttcccctggcaggcgggggcatgaggctgccacggggaacacaggtttccttgcacctggccctttaccctgtcagctttgctgttttcatgtgctctgacgccctcccattaggtgcatccaagctgcaatgcccacttcctcctggcaggggggacccgcaggcaccttctgctcagaggtgcacttgtctggtggccctgctccttcctggtactgttgacctttctgtgtgtttgttttaaatctcttgcatggtaaatagctgcattttgttactgataagagtgagtttaaatccactgtcatatcttttgcgtctttgttacacattttgttttttaaaaatcttctttcttgtccttttttagattgacagtgtccctcttacctcactttctccactcagtttgtaatcctgcagtctgttgcttttcttttagcgtttgccctaaaggtggctgcatgtgtcctcactgaagtccagcatgggccccaaatgcaggctgaggtctgggtctggctgggctgctgggcgcccgagtcatcatgaccattgttcctgggcacagccggcgttgacttgtatttcctccgtgattaccgcctggctcatcaatcactgttttcgttttccgtggaggcgtggctcacacaaagggcaagcacggagtcactgggtcctgcaggactttccaggtcaaggcagaggaggtgtccggtccccagcaggctcctgtgtgcccctcagtcccctagagggtcacggccacctgaccgccaccactagaggttttggcgattgtgctgtgtggtgggtcttcccggcctctgcttagcacagcagtgctgctgcccatccttcctccttgccaggtagtgccgggtgctgctgcccatccttcctctgccgggcagtgccgggtgctgctgcccatcctttctccttgccgggtagtgccgggtgctgctgcccatcctttctccttgccggacagtgctgggtgccgtgtgggctgcactgtgtgtgtgtttctaggtgatggacattcagattgttttttggtttggggctgctggggatggcgatgctttgaatgttcctgggagtgtctgttggtgggtagagcatgcatttctctttcgtgtgtatataggagtggaatcaaggccgggcactgtggctcatacctgtaatcccagcagtgtgggaggctgaggcaggaggattacctgaggtcagaagtttgcgaccagcctggccaacatggcaaaaccccgtctctactgaaaatataaaaattggccaggcatggccaggcgcagtggctcacccctgtaatcccagcactttgggaggctgaggtgggtggatcacgaggtcaggagatcgagaccatcctggctaacatggtaaaaccccgtctctactaaaaatataaaaaattagccaggcgaggtggcaggcgcctgtagtcccagctactcgggaggctgaggcaggagaatggtgtgaacccaggaggcggagcttgcagtgagttgagattgcaccactgcactccagcctgggcgacagagcaagaactc

SEQ ID NO: 3838 - DNA, 1641 bp, Homo sapiens
gcgaacattaggttaaaacagagatcctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctggtgagtgcctccatgctagcctggccgccacccctggccatgtccaggatggagcaggtcctggcagattgtgtccctctaagtgaaagcaccatcctgctttgaattgtctagaaagatttccctacttactattttgcaaaattctaaactttttgaaaagttgcaagggtggtacctttctacccttcgccatatgatggtggctcacacttgctttgacagctggctgcagacaccatgcgtggccacactccccaggtgaccatgcctctgagggttcccagagcctaagacagccatccctgagcccactgctctagctcattctgggatctattcaaagacacagtttggtttagtttggttgtctcttagacttgtttgcccaagaggagcctttttactctttttaagagatggggagaccaattgtttcgtagaatgtccctcaatttacatatgtgtgatggtttcttcgcaattagactaaaaaaattcacgtttccttgttttaaggctaattttttttttttttagtggtcttgctctgtcgccaggctggagttgcagtgagctgagatggctaaaccgcactcaagcctggacaacagagtgagactccgtctcaaaaaaaaaaaa

SEQ ID NO: 3839 - DNA, 443 bp, Homo sapiens; identical to SEQ ID NO: 3829

SEQ ID NO: 3840 - DNA, 1651 bp, Homo sapiens
tgggggtgccccccttccctcaacctctggcatcgccttcctcctagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgtgaccgtggagagcgcggacctgcagggctgctgctttgctgggcctggcagcccccacccgtaaggcccccacccgtcggggtgtttcctggcccgggtcaggcaagggcacccatcaatggcagggggctaggcaggcaggcctgcaggggcacagcctgtgaggagacgtatgctgcatgtccttcccaggagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtg

SEQ ID NO: 3841 - DNA, 3666 bp, Homo sapiens
tctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaagattcaggtggtgccgtgcacggctgggtcacacctctgctgtcactgactggctctggcccttcttctgggaggatttcaggagtttctgagccgaggattcccgtcagggagtgtaattgtgtaactgaagtcccgctggttcctctggcctctcaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgaggattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccggtaagcaccaccccctgccccacccccacgccgcccggcagccccgcctgatgcccccacttcacagggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcc

SEQ ID NO: 3842 - DNA, 834 bp, Homo sapiens
ccccacccgtaaggcccccacccgtcggggtgtttcctggcccgggtcaggcaagggcacccatcaatggcagggggctaggcaggcaggcctgcaggggcacagcctgtgaggagacgtatgctgcatgtccttcccaggagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccggtaagcaccaccccctgccccacccccacgccgcccggcagccccgcctgatgcccccacttcacagggttcctggtgctgcactcggagcccaggcagcagccgcaggtggacctggaccagctcattgcgggtgagcacccctccacggggcccctccgctgggccctgctgaccctgtaggcacccgcagggactaagtgattttcctggatttcaggactttttccctgtcactggtgacctcatcgtctctagtaattcacggaaacttcttaactgttccaagagagcttaaaa

SEQ ID NO: 3843 - DNA, 2058 bp, Homo sapiens
tgggggtgccccccttccctcaacctctggcatcgccttcctcctagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcccccctcctctacccccagcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctccc

SEQ ID NO: 3844 - DNA, 880 bp, Homo sapiens
ccccacccgtaaggcccccacccgtcggggtgtttcctggcccgggtcaggcaagggcacccatcaatggcagggggctaggcaggcaggcctgcaggggcacagcctgtgaggagacgtatgctgcatgtccttcccaggagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcgagtga

SEQ ID NO: 3845 - DNA, 1476 bp, Homo sapiens
ccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagcggccccctttcccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcgagtga

SEQ ID NO: 3846 - DNA, 2047 bp, Homo sapiens
tgggggtgccccccttccctcaacctctggcatcgccttcctcctagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcgagtga

SEQ ID NO: 3847 - DNA, 3131 bp, Homo sapiens
accggcccggtccatgtccctgcagaccgtcccgcccgcgcacagcggcgggaaccccagcttctgcgcgcccggccgcgccccgggcctctgcaccgcctcgctcccgctgcccggcgcctttgtccgctctgcgcccctggagtttctgtgcctccacgggcgggagcggggcgcgaaggtctgggggtgccccgaggacgcgccgcgtagtgagcctccgggcccaagatgaggaaattgaggcacagagattaactaatctgaaccagataatgccataagtagtagaactgcgatgcaaacttggacagtctgactccagagtctgcacacttaaccactccactattctggccttctacaagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaaaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaagggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagagtaaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctggcttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaaacagacaaactgagacccagagacggcactgtgtctaagagcaacagaaaaagtggtttgagcagtgtgctcttgatgacagtgttgctgtgttaaacgaattaatacatgaaaggacttggaatactgcttgacatatcgtgaggcagagacacaaagatatggaagaacattggacagatttacatcgatatattaattaaggtgatttcagagttggagcaggagaggaagccttatagatatttttttttctttttgcttgcttgtattttctttttaattattattcagtatttcaagtagacagaaaagtacagaggataatacaacaaatatccaggtacccaccacccagcatttttacatagtagcatttgatgttttgaaataagacataaaacattccaaataccctatcaccgaggatcctgcatcctcttcttttcccagaagtgaacatttctctgaatttgatgcttattatgcccatgcatgttgttatacttttactacatattttatgtagctacagcataatatgctatgtttactttatatagtgacctcatactatacatatcctcatgcaattttttagactctgtttgagaattatatattttgattcaggtagcttaagtttattttagctactcagtagtaatgtattctattaatctactaatatatatttcttgtctatggacaaaaaaaaaaaaaaaa

SEQ ID NO: 3848 - DNA, 1956 bp, Homo sapiens
gtgcgtgagtttggtggcggccggctgtgcagagacgccatgtaccggctcatgtcagcagtgactgcccgggctgccgcccccgggggcttggcctcaagctgcggacgacgcggggtccatcagcgcgccgggctgccgcctctcggccacggctgggtcgggggcctcgggctggggctggggctggcgctcggggtgaagctggcaggtgggctgaggggcgcggccccggcgcagtcccccgcggcccccgaccctgaggcgtcgcctctggccgagccgccacaggagcagtccctcgccccgtggtctccgcagaccccggcgccgccctgctccaggtgcttcgccagagccatcgagagcagccgcgacctgctgcacaggatcaaggatgaggtgggcgcaccgggcatagtggttggagtttctgtagatggaaaagaagtctggtcagaaggtttaggttatgctgatgttgagaaccgtgtaccatgtaaaccagagacagttatgcgaattgctagcatcagcaaaagtctcaccatggttgctcttgccaaattgtgggaagcagggaaactggatcttgatattccagtacaacattatgttcccgaattcccagaaaaagaatatgaaggtgaaaaggtttctgtcacaacaagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaagattttatgtttacaataaaaagaaacgtcttgtcaacacaccttacgtggataactcctataaatgggctggtggtggatttctgtctacagtgggtgaccttctgaaatttgggaatgcaatgctttatggttaccaagttgggctgtttaagaactcaaatgaaaatcttttacctggatacctcaaaccagaaacaatggttatgatgtggaccccagtccctaacacagagatgtcttgggataaagagggtaaatatgcaatggcgtggggtgttgtggaaaggaaacaaacgtatggttcgtgtagaaagcaacggcattatgcttcacatactggaggggcagtgggtgccagtagtgtcctgctggtccttcctgaagaactggatacagagactataaataacaaggttcccccaagaggaatcattgtttctatcatatgtaacatgcaatctgttggcctcaatagcaccgctttgaagattgcccttgaatttgataaagacagatcagactgataaccttaacaccataggtgcaaaatgagttgttctgaggtttttttgaaacattaaagttccaaaacatgacatttttaagaataaatttgaaatagagtataactgaatgcagagaattatgtacctctaattgcttaattttgtaatggtcttttattgtagaattggttctttatactcagggaagtaattatattgtttttactttttgaaaaaagtgttaactcttgaaataaaatattctgataaaataaaaaaaaaaaaaaaaaa

SEQ ID NO: 3849 - DNA, 1388 bp, Homo sapiens
gtgcgtgagtttggtggcggccggctgtgcagagacgccatgtaccggctcatgtcagcagtgactgcccgggctgccgcccccgggggcttggcctcaagctgcggacgacgcggggtccatcagcgcgccgggctgccgcctctcggccacggctgggtcgggggcctcgggctggggctggggctggcgctcggggtgaagctggcaggtgggctgaggggcgcggccccggcgcagtcccccgcggcccccgaccctgaggcgtcgcctctggccgagccgccacaggagcagtccctcgccccgtggtctccgcagaccccggcgccgccctgctccaggtgcttcgccagagccatcgagagcagccgcgacctgctgcacaggatcaaggatgaggtgggcgcaccgggcatagtggttggagtttctgtagatggaaaagaagtctggtcagaaggtttaggttatgctgatgttgagaaccgtgtaccatgtaaaccagagacagttatgcgaattgctagcatcagcaaaagtctcaccatggttgctcttgccaaattgtgggaagcagggaaactggatcttgatattccagtacaacattatgttcccgaattcccagaaaaagaatatgaaggtgaaaaggtttctgtcacaacaagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaaggtaaatgaataccttctgctgtgtctagctatatcgcatcttaacactattttattaattaaaagtcaaattttctttgtttccattccaaaatcaacctgccacattttgggagcttttctacatgtctgttttctcatctgtaaagtgaaggaagtaaaacatgtttataaagtaaaaaaaaaaaaaaaaaaaaaaaaaaaaaaaaaaaaaaaaaaaaaaaaaaaaaaa

SEQ ID NO: 3850 - DNA, 2022 bp, Homo sapiens
ccacgcgtccgcccacgcgtccgcccacgcgtccgcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtttgtgattaaaagtgcttcaacccaaaaaaaaaaaaaaaaaaaaaaaaaaaaaaaaaaaaaaaaaaaa

SEQ ID NO: 3851 - DNA, 1077 bp, Homo sapiens
aaatcaaatagctatccatggaatattagaacttgacttgctccatcctcttaaactttttgtgtctcacactaaagaaatgagagatgcagaattctaaggctaaatagctaggaagtattcattcaaacttgaatattcttcaaagagagtgtgggggcaactctaatcagaggaagaaactaaaggaagtaaaaccagatgttttccaccaaagccctccttttggctggtctgatttctaccgcactggcagggccatgggctaatatatgtgctggcaagtcttccaatgagatccggacgtgtgaccgccatggctgtggacagtactctgctcaaagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagaggtttttgtgtcaaaatgttctacattaagccaattaagtataaaggtcctattaagaagggagaaaaacttggaactctattgcccttgcagaaagtttatcctggcatacaatcgcatgtgcacattgaaaactgtgactcgagtgaccctactgcatacctgtaaatcgaaggccaatggtcagatcttcaaaataaaaagtcatcttaaaaacctggatgcatacccttctcttcaagaaatttgtgttcacaaaggaaaaatgcatgaagggatggataccccattttccatgacatgattattacacattgcatgcctgtatcaaaacatctcacgtacctcataaacatatacacctatgtacccacaaaaattttttaattaaaaaaaggaaatttgagtttaaatagaaacatgataaatgcaagaaagaaaacattttgattttaactcattgtcactctgatgttcatgtgaactggttgcttcgggctctttgatctgtcacctatggaatctgagtggttttattttttagatttctcagtcccaaagatctaagataaataaacaagagaactt

SEQ ID NO: 3852 - DNA, 2026 bp, Homo sapiens
acggttaactttgacccaaagacaacctcttctctcccgcttctctcgctgtgaagatggcgctctccagggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttgatggaaatgaa

SEQ ID NO: 3853 - DNA, 2017 bp, Homo sapiens
acggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttgatggaaatgaa

SEQ ID NO: 3854 - DNA, 1934 bp, Homo sapiens
acggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttgatggaaatgaa

SEQ ID NO: 3855 - DNA, 1645 bp, Homo sapiens
acggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttgatggaaatgaa

SEQ ID NO: 3856 - DNA, 2133 bp, Homo sapiens
acggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttgatggaaatgaa

SEQ ID NO: 3857 - DNA, 3285 bp, Homo sapiens
cgcgcgcccccgccgcccgcgccgcagtccgcagccacccggcgcggtcagccccggctgcggctccagctccgcgctccgctcttctctcccgagccggatcgcgggagcgagcaggggaggggaccgcagccggcgcccgagggcaggaggagtccgcaggcgggcccctggctgcggtagcagctgccggtggcagggaggtgccagcccgcgcggggtggcccagccgcgggagcggtggggcgggggccgcggccgccggccccagggagagatcgcgggcagcatggcggggctgcgggccagggggggcccggggccggggctgctggcgctctccgcgctcggcttctgcctcatgctgcaagtcagcgctaagaggccccccaagacgcccccctgcccgcccagctgctcttgcaccagggacaccgccttctgcgtggactcaaaggcggtgcccaggaacctgccctcggaggtcatctccctgaccctggtgaatgccgccttctcagagatccaggatggagcgttctcccacctcccgctgctgcagttcttgttactcaactccaacaagtttacactgattggagacaacgccttcacaggactgtcgcacctgcagtatctcttcattgagaacaatgacatctgggcactatccaagttcaccttccgaggactcaagtccttgactcacctctcgctggccaacaataacctgcagacactgcccagagacatcttccggcccctggacatcctgaatgacttggacctgcggggcaactcactcaactgtgactgcaaggtgaagtggttggtggagtggctggcacacaccaacaccacggtggcacccatctactgcgccagcccgccccgcttccaggagcacaaggtgcaggacctgccgctgcgggagttcgattgcatcaccacagattttgtgttgtaccagaccctggccttcccagcagtgtcggctgagcccttcctctactccagtgacctctatttggctctggcccagccaggagtcagtgcctgcaccatcctgaagtgggactatgttgagcggcagcttcgagactatgatagaatcccagccccctctgcagtgcactgcaagccgatggtggtggacagccagctgtacgtggtcgtggcccagctgtttggcggctcttacatttaccactgggatcccaacaccacgcgcttcaccaggctgcaagacattgacccgcagcgcgtgcgcaagcctaacgacctagaagccttccgcatcgacggtgactggtactttgccgtggctgacagctccaaggcaggcgccaccagcctctaccgctggcaccagaatggcttctactcccaccaggcactgcacccctggcaccgtgacaccgacctggagtttgtggacggcgagggcaagccacggctgattgtgtccagcagctcccaggcacccgtcatctatcagtggagtcgcacccagaagcagtttgtggcccagggtgaggtgacccaggtgcctgatgcccaagctgtgaaacactttcgtgccggccgcgacagctacctgtgcctcagccgctacattggcgactccaagatcctgcgctgggagggtacccgcttctcggaggtgcaggccctgccctcccggggctcgctggccctgcagcccttccttgtgggtggccgccgctacctggcactgggcagtgatttctccttcacccagatctaccagtgggatgagggacgacagaagtttgtacggttccaggagctggctgtgcaggctcctcgggccttctgctacatgcctgctggggacgcccagctactcctggcccccagcttcaagggacagacgctggtgtatagacacattgtggtggatctcagtgcctagggggtgccgaggcctctggtctcctcagggtggccactggaggatgggtgggggcctctgtgagcaccacgtatgcctgtgtgaagacaagcgaccaacctgcattcatgcccttgtatccgcacacgcccagtgtgtacaggcgcaccccgtggactggcccaggaggacgtgcatcatcactgcaatcagcatgaacaccaggcacccctgggacacctaacgcccagttcccgtgaccccaactgcaggccccccctactctgcagcctttcccatgctctgccccctgtctcatgcacgagtggtgcggggtgctgggagcgaggggggccgcatcctcctgtccttgtgcttctccttctgcccctctggtctttcctgttggtgctccaggcattgtttacctgctcttgctccccgctgtagcccacagccatatctgtcatgcttccccggggccactcacccctgccccaccccgtctgcatgctcacatggacgcggacggacacactcattacacactcacacgccccgactgcacccggtgtccatctataaacatgtcagggcacgtgtgcatacaagcagattcagcactgcctaccaggctctcctgttaccttgcctctctgcttggagggggccccctctgctcacccccagcgtgccccccccggaactgataaggatgagaatggtggtgccagcttctgagggcctgcttggcctcctgggggcaaagcccctctgcccgaagcaataacaacagcagcagaagcaatcccggggagctgccaggggtgtctgtctctgttctccttggcgtttccttcatggccgtgaatcccagctcacccatggacagaagacctcccctcatctgaaagcctttctgccttccttcctgtagctgtcgctttctcaggcttggactgtcccctggttcaccctgtctttgggatgtggcccttgagctgggcgggctccttgggtggattagagagctggccgagctgcaagcacctgagttacctgcgagggtgcccagagtggagcttggcctgagggcgtgttgcagccctggccccaccagtccacagaggcccccaggagcactgcctttcagtggaccgggtgggggctggtgggaggggccccactagctgagcttctgctgccctctgctgtctgctgagatgccaggctagtggagagggcacaccatgtgcccaaatggtgtgatgctccttgtagcaggataccagggtactggggggcaatgctatgattaacttgcttcaaataaaaagttcccgccccataaaaaaaaaaaaaaaaaaaaa

SEQ ID NO: 3858 - DNA, 4115 bp, Homo sapiens
ccacagcgctgtagactgcgccgcattagaagcctggcctcctgatgctgtgctcttcatctagacccaagccccaggtcgtgggacgatttctcccgtttttgactccctggaactgtattgcctgctttacctgcgtacatgttgattctttctcatggcaaccccgcaggaaaccatcaagatctcattttacagctgggattctctggttcacagaggtaacggagcttgcccgaggccagttaaacgagaagattcatcaccgctttgatggctgcctcacaaacttcacaaactgttgcatctcacgttccttttgcagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaatacatttagaaacttttaaagtcatgaaaaagcattaaccttctaaacagtatattctaaaaagtcaaaacgttaacaatagtttttatctaataaaagcactgcaagaaaatagggtagaattgttacagctggacttgtaaaaatatgtctttttactcagggtttaaaatgtcccatttaaatatgaaatgtaaacaaatttgttttttaaggttaaggccaaatgtaacaataaaaccctgtcgatggttttagctaaattagaggaagttgtatgagacttaatgatctaaaaacttaaaattgaattggtttgattaaaaataaagcttgcaattttaaaagtagctcacatttaatttcttgtgtgaaatagaacatgctttaaaggaagtatttttatgtgaatttgcattccagtataaatagtattcacaaaaaagattttcctagattttatctattgaataggtgtcaatatggcatgcatattgtaactttcattagaaataagttgctttgacttttaaaaatgacatagttagattatttaaagtcaatgtatatagtatatattatgtatggatttatataccaaattttggaatacagcctatctcatgaccatattgaaatgtacggaatttgatccatgcgatactatgtgtgcattatttgaaagttattggaaattttattcaaaccgtggaacaaatgtatgtgattttgttatacttcttaatttaaataaaatatttaatgcactattaaaaaaaaaaaaaaaaaaa

SEQ ID NO: 3859 - DNA, 3994 bp, Homo sapiens
cttctggcgccagcttccggcttagcggctgagcttcaggcttgacgtcaggaaaccatcaagatctcattttacagctgggattctctggttcacagaggtaacggagcttgcccgaggccagttaaacgagaagattcatcaccgctttgatggctgcctcacaaacttcacaaactgttgcatctcacgttccttttgcagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaatacatttagaaacttttaaagtcatgaaaaagcattaaccttctaaacagtatattctaaaaagtcaaaacgttaacaatagtttttatctaataaaagcactgcaagaaaatagggtagaattgttacagctggacttgtaaaaatatgtctttttactcagggtttaaaatgtcccatttaaatatgaaatgtaaacaaatttgttttttaaggttaaggccaaatgtaacaataaaaccctgtcgatggttttagctaaattagaggaagttgtatgagacttaatgatctaaaaacttaaaattgaattggtttgattaaaaataaagcttgcaattttaaaagtagctcacatttaatttcttgtgtgaaatagaacatgctttaaaggaagtatttttatgtgaatttgcattccagtataaatagtattcacaaaaaagattttcctagattttatctattgaataggtgtcaatatggcatgcatattgtaactttcattagaaataagttgctttgacttttaaaaatgacatagttagattatttaaagtcaatgtatatagtatatattatgtatggatttatataccaaattttggaatacagcctatctcatgaccatattgaaatgtacggaatttgatccatgcgatactatgtgtgcattatttgaaagttattggaaattttattcaaaccgtggaacaaatgtatgtgattttgttatacttcttaatttaaataaaatatttaatgcactattaaaaaaaaaaaaaaaaaaa

SEQ ID NO: 3860 - DNA, 2654 bp, Homo sapiens
ttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaaaaaaaaaaaaaaaaaaaaaaaaaaaaaaaa

SEQ ID NO: 3861 - DNA, 3155 bp, Homo sapiens
ccaccttcctcccaccccgggaacccggaagtggaggaggaggcgcggcggcggcggcggcggcggctgcggtggccaagcaggcagatactgcctgacccgttcccgggagcgtgtctgggtttgggggcgggagacaggctgagccgcctgggcggcctggcctgtacggggcgggggaggccatggcctcggctgagttgcaggggaagtaccagaagctggctcaggagtactcgaagcttcgggctcagaatcaggttctgaaaaaaggtgttgtggatgaacaagcaaattctgcagctttaaaggagcaactgaaaatgaaggatcagtcattgagaaaactacaacaggaaatggacagtttgacatttcgaaatctgcagcttgccaagagggtagaactacttcaagatgaactagctctaagtgaaccacgaggcaagaaaaacaagaaaagtggagaatcttcttctcagttgagtcaagagcagaagagtgtctttgatgaagatctgcaaaagaagatagaagagaatgaacggttgcatatacaattttttgaagctgatgagcagcacaagcatgtggaagcagagctgaggagtcgactggccactctggagacagaagcagcccagcaccaagctgtggttgacggtctcacccggaagtacatggaaaccattgagaagctgcagaacgacaaggctaaactagaagtgaaatctcagactctagaaaaggaagccaaggaatgtcgacttcgaacggaagaatgtcaattacagttaaagactcttcatgaagatttgtcaggtagattagaggaatccttatcaatcatcaatgaaaaagtaccttttaatgatacaaaatatagtcagtacaacgctctgaacgttccactccacaataggagacaccagctgaagatgcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttaggaagattcttccctatcagttaaaaagtttagaagaagaatgtgaatcctctctttgcacatctgcgttaagagccaggaatctagagctgtcccaggacatgaaaaaaatgacagctgtgtttgagaagctgcagacttacatagctcttcttgccttgccaagtacagagccagatggactccttcggacaaactacagttctgtgttaacaaatgttggtgctgctctgcatggatttcatgacgttatgaaagatatttccaaacattatagtcaaaaagctgcaatagagcatgaacttccaacagcaacacagaagctgataacaactaatgactgtatcctgtcatcagtagtggcattaacaaatggagcaggaaagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaagcccctcttggagtctgtgccttatgaagaagcactggcaaaccgccgcatccttctcagctctactgaaagtcgagaaggccttgcacagcaagttcaacagagtttggaaaagatttctaaactggagcaggaaaaagaacattggatgttggaagcacaattagccaaaatcaagctagagaaagaaaaccagcgaattgcagataagctgaagaatacaggtagtgcccagctggttgggctggcccaggaaaatgctgctgtgtcaaatactgctggccaggatgaagccacagctaaggctgtgttggagcccattcagagcaccagtctagttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaaggggaattctaaaaagaacaagagtcgatagttttgaaatagctggttggcgactgttctttccagacctgctcctgctgcacagagccgcagggctgagaccacgtccatgctggctgccttcaggaagctaaagtattgttggacctagtaaactagtcagtgttggaaacggccttgaaatatttaaaacatatttgtaaccagtgaggcaaatacagaagttgatgtcggcagtaaatggaaaacaatacgtatgtcatggatattgtaggtttccttatgctgtttttactgtgcactttttaaaattaggttttaatttcagtatgtaagaacaaatattttgtatactttcaaactcaattatatggtaatcgatttggtatctatggaatagatatatgtttctggaaaaaaatgcttaaattgtcaaactgtcattacttcttattatagttgaaggcattctccagattctttttaaaagatttgttcaaatttctctctctctctctctctctctctctcttctttctctctgagggagagggagccctccaaacttcagatcctgtgggtttagtatcattatcttcagctctttgatcccctgtgttagagtaatagctaaaggaagttcatgtcaataaattcatacttatatcccaaaaaaaaaaaaaaaaaaaaa

SEQ ID NO: 3862 - DNA, 1922 bp, Homo sapiens
atgggccccgccgctcgccccgcgctgagatcgccgccgccgcctccgccgccgcctccgtctccgctgctgctgctgctgcccctgctgccgctgtggctgggcctggcggggcccggggccgcggcggacggcagcgagccggcggccggggcggggcggggcggagcccgcgccgtgcgggtggacgtgagactgccgcgccaggacgctctggtcctggagggcgtcaggatcggctccgaagccgacccggcgcccctgctgggcggtcgtctgctgctgatggacatcgtggatgccgagcaggaggcaccagtggaaggctggattgcagtggcatacgtgggcaaggagcaggcggcccagttccaccaggagaataagggcagtggcccgcaggcctatcccaaggccctggtccagcagatgcggcgggccctcttcctgggtgcctctgccctgcttcttctcatcctgaaccacaacgtggtccgagagctggacatatcccagcttctgctcaggccagtgatcgtcctccattattcctccaatgtcaccaagctgttggatgcattgctgcagaggacccaggccacggctgagatcaccagcggagagtccctgtctgccaatatcgagtggaagttgaccttgtggaccacctgtggcctctccaaggatggctatggaggatggcaggacttggtctgccttggaggcagtcgtgcccaggagcagaaacccctgcagcagctgtggaacgccatcctgctggtggccatgctcctgtgcacaggcctcgtggtccaggcccagcggcaggcgtcgcggcagagccagcgggagctcggaggccaggtggacctgtttaagcgccgcgtggtgcggagactggcatccctcaagacacggcgctgccggctgagcagggcagcgcagggcctcccagatccgggtgctgagacctgtgcggtgtgcctggactacttctgcaacaaacagtggctccgggtgctgccctgtaagcacgagtttcaccgagactgtgtggacccctggctgatgctccagcagacctgcccactgtgcaaattcaacgtcctggggaaccgctactccgatgattagctgcccagctggactctgcacatggggatggacccttcctgcctgcaccccggtcctcagcctgggctcccaggacaggacaggatgggacagcaggatagacaggacagcaagcccagtgggtgggaggaaggatgagggccccaccatgtccacactgggaaggagggccccacagcttcagactgaggatctagggctgggacctgtcagtcaaggaagagaggtcactttgggaccttctctgcaatcctgtgacgtgagtctgccctccttacaggcagctcccaggtcaataaggaaagagaatatggggccagtgtagctgtcgccagggttctgggagctccctgtggcctgtctgggaattcctgggggctgagactacagtggccaggttttgtgcttatttattggggggtgggttgagggaagagctatctggccttggggtaccctggcctgaccgtctttcaggatacttcttgtcaaggctgtctgcctgttgcctttggtcctcaagcactgggagccatgggtcccactgcctgtccagcctggctcccttcctgggcctggctaggaccagaggtcttagaaaccgtcctgttctggaatccttggctgcggctttgtgttgctgaccgggatactcgaagccacaggatcaatgtggtgcctcatccaggggcatccttttttttttttttttttttttttaaagagttggagtagggaaggtttaatagtaaaataaacgtggctatattttaacataagatgtaaaa

SEQ ID NO: 3863 - DNA, 3037 bp, Homo sapiens
ctgagaaagacctgttgaccacaaagccttgtcactgtaaggatatcctgaagttagtgctcttacccctcacccagcattgcttggtcgttggagaaaccacctgtgcattttattacctgctggaggctgcggctgcctgcttggacctgtcagataattatatggtctgtttcaacatgggacgtatcactttagccaaaaaattggctaggaaagcccttcgactgctgaaaaggaatttcccttggacctggtttggtgtccttttccagacattcctggaaaagtattggcattcctgtaccctgagccaacctccaaacgaccctagtgagaagttgtctctacctatgtggagctctctcagttctcccagagtgtgggcatcaaggacaagtggctgcactgtgagcagatggccattcagaaaagcagtttatgttggttctccagggaggggttgttggccacagctcagctcatgcaggccctggcctacaccaagctctgccttggtcatcttgacttctccatcaagctgggtaatgggacttagggatggtgggtctagggcttttagagagtacatgttcacagctagacctcacatggtgctcttaaacctcctcaggttttcaagctcgtgagatatgcagagtcagagctactatatattcctcagtacttgggtctcatggacaaagtttcttcaaaaaaaaaatctgcagggagatagagaattgcagcagctgaagactctggaaactgcctcagaggcaatctcccacctcctttgcctagagatgggtctgatcccaggcttagatattctctttataaatagagctatgaagagatttaaaggatgttaggctgctttgaaggtgtaagaccccttcctttcctacccatcctcctcactccctagctggtcccagtggctctctctctcggcagatttggtctgtgtgtccatgtactggagagtcagtgggcgctcatttctcagagttatgatgtccttggcctggcctgcttttactctgcttgcttagatctgctgctctatggaaaaggtaaatcttgcgcaggtctctgctgtactcctgagggattcagacctcagatggggctctaggtttggaatacaggcagtcatgaacctgtccctcaggcatggcctctgcccctgacctctggctccttaaagtctgggaaccatgttgtgattcaggggtgtctgcctttggggtcttttttccttccctgtatcacataccttctataccctggttcctacactgatattatatactagcgtggttaccttctctgtccacaggattgctgtgtcggccctttagtgagtgtctgcgtttcgttcaagtctacgagcacagccgtgttctaacctctcagagcaatgtcatgctgggggtccactcctccctggccatgtggtaatgtcttactcaagggctgtggaaaaggatagacatttatgtcatttaagctgtctctccccaccagacaggacttttgaacctctctaaccaacttttaaagaccattcacctcccataccctcccatcttattagaagggctcttgtcctttaacaggttttggcctataggtcaagggttacgtttagggttacatttaactgctagagtaacccatagcaaggctgaatataattggtctccttttaagtttccttgtatgtgagttagtagccttggtcactttctagcatcacaattctgattgtccatgaggtcttagagccttaaagaagtgatgattttaagcaaaagtcatggtgggtaagcagcggatattgctgcaagctgttactcttttcctccaggtttgcccaggaatcacagtgggacctgtttaagcactatttctccaacgcttgcagttggtgaaaagaaccaatgcctcgctatttggtgcacatggctttgtccgattcctagaatgccatgtgttaatgttacagaaaatgccagagggtatcttcatgcatattcctctagagcttcacagccaaacccttgaggtacctgtttctcagctgtcctttgactaacacctgattcacttagttctaccctatggtgctctttctaccacctgcatctcttccttttttcccttttactggctctgcttccctttactctttgaatcctttgtttctccacctagaaagtttctacctaccttatgtatccttcccgatattattgcatctagttctggactgggtttcttaactttccacctttgccagctgctacccagtatcattaaaatattaacatttagccttgctcaatggacctgtagtctatggttcagtctataatttgatacagctccctccagcccttctgagtctaaaacacattccaattcctctgttttccaggcttattttgccatcagtaactccttcctgttcccccagccatgagtgaatatgctgaatgaggacctttgtaagttctgatgaagtagcatttaggagaatgaagcactaatcccagagctaatggaccttcctttcctttcagtactgtaaggagttcttctctcaatgtgtgacctgccctgtctatcaccagtgggtatctgagcttagggcctctgtaatgagatgtgaaaagagagaattgatgtccctgactaacagcatcagaccttttgacacctgcttgaccaggatttggataaaaggagaatttctgcaggaaaataactcttagaaaagaaacttaggaatacagagatttgacagagtggctgatgtcaaggagaacaaggatgcagaagaaactcaagatgtatgtattaaaacaaaagaacaataacctgaagggaccatgattctgttattgtatataacacaaggaaatgccccagattctcctttaaaagatataatgtacatattaagtatactagcctttatagttactgctatctacatgtttatcaaaataaaagactatttttttct

SEQ ID NO: 3864 - DNA, 4211 bp, Homo sapiens
caggacaaacaaacaatgatagattcatacccaagctgagaggggcgaactgtaatgccatccagcttccctcccagtacaacagggccctctggctttgtgtgggtgcttgtggatagacacctcacttccttccaaggtagctggttccacttccagccaacagctcaggctgcctcccagcccagctatcctgcaggttccagccccacagcacgtgtgtctctgtgtcctctagccagtaggcttctcccccagaatgctggatttcttatggagattttcctggataagatgagcaattgggctgaccattggaccatgtgtattgatgcagttattgtatgcacccagagatggagaggcctggtgcttccattctgatgtgctcttggagaaagccattgaggaactgtggtcagcaggtgttccaggagtttcagcgccatgggcttagtggggcttcatggccctgtgtatgcatttccgtgtcctgcagccagggtgtcagctcactgcattcattcaatagctcctgagttcccactgcatgccaggtactgtgtgtgtggtggtggggggtgactttttatcaagcaaagtcaaaccacacatgccccctgccttttaagagttcaagatctgtagcacagacagccatggggactaggagctccagcaccgtgagctgtagtggatgtacacagagtgccccgtgggcaggcacaggtggcagctaattccagccgggctggcttggggattccttatgtgacacccactgtagacccagcctgcagctgtttccttcagtggtcacctccgcctgatgaaggaaggcaatgcgttctcgtgtgaacggctgctctttgcttctggtccaggcctgctcggactccatctcgctcatggcgtggctttgaaatgatgctcatcaggctccctgacctgctcagggataggccactgtgagagttccgctttgattttcaagcagctgagacaccagaggcgtggtgaatccccccagccctcccctcagaataagctatctgtccggtgagaatagtcactcctcctgttctttgaggacaagaccagcaaaagacttgagtcaccatttccaaagaaaaacaaggagaatgcaaatttctcggcttaaaaatatatacaaagggattgattctatataactctctggagtaagaagagctgtgacttccattggctggtgctgtttagagaaggatcgctgtgctgaagttgaaaaagagtgtattcagctttgatatttggagaaagtgtcccaaccatcatgtatttctgcctggttttcttttagaatgcaccagctggagtcgacattaaagggccccatttcccatttgctgcagaagatgtttaattggaagtctctccctgtccttttgtaagcctcatttctgcatattagctttacacatgagttctggggtgactggtcaagacgggagtctgtgtgtaattagaccagaccaaggaagaagcaggaagtttgctggcggagaacatgggagtctctgtatcgcctttaatcactcttcctgcttggtgtaatgttcacatgttgtctttcatcacagccatggggacagagcgccagttcatgctatctcctcacggggcccttcggtccatctccacccaccacccagccctcactgtcatctgtctgaccccattggccttgctcttctttttggaacatgataacctcccgccagccgccccagcacagtctcaggacgtttgcatgtgtcgtggcccctgcacactgtttcctcagctcctggcctgcttgttcccttcccattacccttgtctctgcttaagcatcagctcctcagaggtcctcctgaccagcccattgcaagtaccctttccccttcctccttgcggttctgttgctccctccaccttgcagctctgcagcttcccgtgaatgtgattgtttacatgctgactatcatgtcccccacctggctgttcaccccttgacaccagcaccagctttctttctggctgcgttgctgcctgtgcctgcagtggtggctccgtaagcatctgctgaacaaacgcatggatgaatgagccctttcagatccaggctgtgtggggctcaaaattaaagaaaacaacatacaaaatgacacatataaaattaggaatggggtttatttaaattcttaaaagctgctaaatttctgtacgtcacaaaactatacagtattgaatattttaatagttacctgattgtattgtacgttttcctacatttttctcttgcatacattttgccttttcatatgacaaaaatgtttggtattgcttttaacaggacagaaagataattcctctagtgtggtcagataaagcttttttttaaagttatggatagttggtggcatgcaacgtgcagatggtcacacagacagactcatgtggcattgggtaaggttttgtcctatagacacaagaattttgatgtattctttttctttctttttttgagacagtcttgctctgtcacccagcctggagtgcagtggagcaatatcagctcactgcaacctctacctccagggttcaagtgattcttgtgcctcagccacccaagtagctgagtagctgggattacaggtgtacacacaacacccagctaatttttgcatttttagtagtggcaggatttcaccacgttggccaggctggtctcaaaatcctggcctcaagtgatccacccacctcggcctcccaaagtgctgggattacaggcatgagccactgcacccgtccttagattctttttcatcccataaaaaaaaaagattcatttacatttgtgtatatgcattacaaattattccttacaagggagaacatttattttgactaggtaataatgagaactgaatcctctcctgataatagcgtgtctgatgataagaagatttttcttagactggcttctggctccatacatttcaaaccttgctccttttcctcttccaccagaccctctggtgctgggcaccaatgagaagctcatctggccccgggatcctggcaggacactgggagcactatttccatgggcagcagggttgttcctggagacatcactgacccaggacacctagcacaatggcactcgatgtgaaagtggcttcgtacaaatctgccactcaagcctaaataagtgcattccagaagagccgcagcccctctaacagctcctgaggtgagggaaaccctagggatgggaagttggagcagaaagagatggtggcctgaagtcaactgcagtgaaaatctctccccatcagcaagttttgcaaagctatggccacagggacacatgactggggcccctcctagtcttggaaggagcccccatggaaatgagggcctcacagtgaatccacctctgatcctacttcacctgcagtcaaatgagaagagatttcaatcagctaaagacaccctatcccctctccccgacccctgcgaccccaggtgatccgccccaccttggcctccctaagtgctgggattacaggcgtaagccaccacacctggccctgggggtcatatatcttaaatcaaggtatcaacaggaccaagctccccaaaagctccaggaaaggatacttcttggcctctcttctggcttctggtggctgcagcaatccttggggttccttggcttatggatgcatcactccgtactctgcttccgtcctcacttgaccttctcacctaccttcctttacgtcatcttccttctgagatgctctgtgtccaaattttcttctttgtaaaaggatgccagtcattggatcagagaccaccttaatccaggatgacttcatcttaactaaattacatctgcaaagattctatttctaaataaacccacattctgaggttctgggtgggcatgctatttggcaggacaaagtcaacacaggacactcattttcaggattgatcgcatggtttgaggaagctgatggtgacatctcttcttaaatctgttttcaggaaaatcatactggtagccttcaagtggccatggtgggagcattgacccagggaaatccacatttcccaacacatgctggatacctgaggactccagagctactatctgctcatatctgctcaacatt

SEQ ID NO: 3865 - DNA, 722 bp, Homo sapiens
cagcttctgccagacagatggaactctccagcatgaaaatctgcgcagccattccaacaagcagggctctgcctgaggttgtccgaaggatgccgaggaaaaggatatcaggactggaatggctcttacagcaagatccaacgatagggccttgggagatggaaaaggaattaatcttctcaccctggcgagttttcctgaaactacttatccttagcgtcagcgctgtaagaggtggagccgctcagtcccgcgggtggctgcagacagaagcccttgaagttaacgtagcgacgacgtggtccttgtaggaccaagcattcttggcattctgtcgagattgagattccagagcatcggatgaacgggacttatagctaaggcgtactcacccacccctcccttcgtctttttacgcacgcagcaactcgtcctcacgtgcataggggtagtggacagtgttgacttgaattgctgtccctcgttccaagcctttcctgtgaatgaacccgaaaacactcgacaggtcgtgaataatcgttttaatgagtgtgcaaagcgtgcgacggggtgcaccgagctgtcgggttaaacaaacaacttgtaccctgaccaaatccgattgttaaagtgcaaagtgatgtcagtaccatttccattgcctttcggaaatccacagatctgacacgcgggagtccaattttccccattaaagaaaaata

SEQ ID NO: 3866 - DNA, 722 bp, Homo sapiens; identical to SEQ ID NO: 3865

SEQ ID NO: 3867 - DNA, 2925 bp, Homo sapiens
atgctgaccgcgctcgccccgccagccctgcctgggatcccgaggcagctgcccacggcccccgcgcggcgccaggactcctccggttcgtcaggctcctactacacggctccaggttctccggagcccccggacgttgggccggacgcgaaaggcccagcgaattggccctgggtggctcctgggcggggggcgggcgcgcagcctcgcctgtccgtcagcgcccagaatagccgccagcggcacgggcccggctcgggtttcccgcgaggcccaggttccggcccacggccaccccagccccagctgcgcacgctgccgtcgggggagatggaagtcatcttcggcgtcggacccctgttcggctgctccggcgcagacgatcgcgaggcgcaacaacagttcacggagccggccttcatcagccccttgccgccggggccagcgtctcccgccgcggtcccacgccagtcccaggtccccgatggtggctcccgctgggccacctacctagagctgcggccccgtgggccaagtcctgccgccccagcgcagttcgagtgtgtggaggtggctctggaggagggcgccgcgcccgccaggccccggacagccgccgcgggcttcgtgcagacggcgttggccagaaaactgagccccgaggccccggccccgagcagcgccaccttcgggtccacggggcggtcggaacctgagacccgggaaacggcccgcagcacccacgtggtcctggagaaggctaagtctcggccacttcgcgtacgagataattcggcccccgccaaggccccgaggccgtggcccagcctccgcgagcgcgcgattcggcgcgacaagcctgcgcccgggacggagccgctgggtcctgttagttccagcatcttccttcagtcagaggagaagatccaggaggcgcggaagactcggttcccgcgagaggcgccggatcgaactgttcagagggcacggagtccgccttttgagtgtaggatcccctcggaggttccgagtagggctgtgaggccaaggagcccgtccccgccacggcagactccaaatggggctgtacggggtcctcgctgcccgtcgccccagaacctgtccccgtgggatcggactactcggagggtgagtagcccattgttccctgaagcctcctccgagtgggaaaatcaaaatcctgccgtcgaggaaactgtcagcaggagaagcccttcccctccgatcctttcccagtggaatcagtgtgttgctggggaaaggagcccgtccctcgaagccccttccctgtgggagattccacattcggcagtcgcggatgcggtggagccacgtagcagcccgtccccgccggccttcttcccgtgggaggctccagatcgtcctattggaacttggggcccatctccccaagagacatgggatcccatggggccgggctcatcgatagcatttactcaggaagctcagaatgggttaactcaggaggagttggcaccgcctacaccgtccgcacccggcactccagaaccaacagagatgcagagtccatccacgcgggaaatttcagatcttgcctttggagggagtcagcagtccccagaggtagcagcacccgagccgcccggcagccaccctgtgggcaccctggacgcggataagtgcccggaagtcttgggtcctggagaggcggcctcgggacgcccgcgcatggccattccgcggcctcgagacgtgcgcaagttggtgaagaccacgtacgcgccaggcttcccggcaggagcacaaggctctgggctgcctgcgcctcctgccgacccctgcggggaggagggcggcgaatccaagacgcaagagccgccagcactggggccccccgccccggctcactacacttccgttttcatcaaggattttctaccggtggtgccgcacccctacgagcctcctgaaccgtccttcgacacggtcgcccgggacgcctcacagcccaacggggtcctgcggcggagggcagagaacagcacggcgaagcccttcaagcgcacagagatccgcctgcctggggccctggccttgggtcgccggcccgaggtaacctcgcgagtgcgagcgcgcggccctggaggagagaacagggatgtagaggcccagcgcctggtccccgacggcgacggtcggaccagccctctaggcggcgcccgcagctcatcccagcgctcccccgtagggccagcaggggtccgatcgccccgccccggctcccctcagatgcaagccagcccgagccctgggatagcacccaaaccgaagacaccacctacggcccccgagcccgcggctgccgtccaggcgccactcccgcgggagcccctggcgttggcgggcaggacggccccagcccagccccgcgctgcctcggcgcctcccacggaccggtccccgcaaagcccctcccagggagcgcgcaggcagcccggggccgcgcccctggggaaggtcttggtggaccccgagagcggccgctactactttgtggaggcgccgcggcagcctcggctgcgggtgctcttcgaccctgagagtgggcagtacgtggaggtgttgctgccgccctcgtctcccgggccgccccaccgcgtctacacccctctggccctggggctcggcctctacccgcccgcctatgggcctatacccagcctctctctgccaccgtccccgggcccgcaggccctcggcagcccccagctaccctgggtctctgaggcagggcccctggacgggacctactacctgccggtgagcgggacccccaaccccgcacctcctctgctcctctgtgcgccgccctccagctcaggtcccacccagcccggcaagggttcattgttcccgctgtga

SEQ ID NO: 3868 - DNA, 1819 bp, Homo sapiens
atggttttaggagaaaaagtggcattgtcacgaagagagggttatgggagttcagtacccttggatcatgtgtgcgttttgtgctgggaccccgtactctccaaccactcactgcatccctataaatcccgcattttataccaacagggtgaagagctgctgatcactacagttccatgggacctgcgggagtggcgattggctgcaccccgcgtcaatcagcggcgttgccgggcaacgggggaaactgctcttatccccatatacagggcaattgggagctcgcataccttcactgccggagcctgtttctcatcttggggtctccacttgatcggaaccccctccccggcccggaacggcggggaccccgtcctccgcagacaataccaactctgttccttgcgggcgtcttttcggaaaccgaggcaccgggaagcagcacgcacgtcggggcaggaaactcttcggacccggcaacttcccggctcgggggctcccggggtccacacccgaccctccccccaggacctgcggggtccctcgtcttcccagagcggcgaggtagtctccaggaccgtctcggacgcgcctcccgccccgggtgccccccgagcccacgcgggagccggcaggagcggggtgcaaactcacctggccggagcggggcacgggggtgcgggggcgccgctgcccttcagcaggagccgacaaactttcgcgggcgcccggcggcggcctggggcgcggggcactgacccgccggggcggaccctgcccgcgcccctcgcgcgccccagcactcagccagggcggaggccggggctgggccgcgcggcctcgcctcttgggccccgcggggcgggggtgaccggcgcgggtcccgcgacccagggcggccgcgaccgtgggcggtggggcaggtgggtcaggcggcgcgtgccctgtcccctccccgggctccggccacacgagcgggccggcgctgcgctgctggcaacgtgtcgcgggaacgctcctaccccatctgcatgccttacatggctcgaaagtaaaaataaaaagaattacgatgcgggcgaggcttgtgggggtgagaagaggagattccacgtctccccagtgctgcgtcctgataggacccccagggccttccgagccctctcccagcgaccacctcgtgtcccggagttgcagcaagagatgtgagaaggtgtcaccctgaagaggaagtggtggaccagccctgcctgatgtggacagcaggggacacatgtctgcctgtcggtctatctgaaatgggggaaaaaatgctgaaagccaaaggagggcttaatgtggccttttccaccttctaattccatagaacctcagctctgggacttgcttcctgacctagggtgcaggggccaaatttgtttgggaacaaccccattcacaattccccatgaactttcagaaaggacccttgcgtcttaggtcctgagaagtcacaaataagcaagctgcattgtctaatgtcttgtctacactgttttacaaacacatttaacagccgaattgtatatgtgccctagaaatcactttgagaaacacttatttcctgatagaggacttgatgggaccattctgcagccccatctgagcatgggctggagagtacataagtatctgggagctggaagtcctcaattccaggcttatctgcccccatcagcgtgggacctcagttcctcctccaaggagaagagcgcccctcccttgatgttttgtgcattcttttgctaaatgtttctctggtcaagaactttaatccccc

SEQ ID NO: 3869 - DNA, 1819 bp, Homo sapiens; identical to SEQ ID NO: 3868

SEQ ID NO: 3870 - DNA, 2049 bp, Homo sapiens
aaaaagaggaaggccttactccgttccaaactgaaaggattaaatggcttcacctgggagaagataaccatcctgccctccattgctacccccacatactgtccatgttctcagggggtactgtgagtcctgggatctttggggttgcccacctgcctgtggtagttatggagacccccaggtgttgaggcagggctggggtgtccccttccaaccaggctgtcaaggccccaactctggggcagaggcagtggcagggcagccagggttgtgccagagcctgagcaggttgaggtggggtcaggcagggctgggagtcagggcaggggcagcagcagtggacccgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcttcacgtgactctcgggcagaagcagtggtggggcagccagggcagcgtcaagagtctgagccagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcgtaagaagcaatagtttctcttactattctgagagccttatcattctacatcccatcttcctgtgagtttgtctttgtagcatttaactctaattgcagttctcattttaaaaactggcttgcttattgtatattttccccaactaaagcgtgaactcctagcagggcgtggtggctcatgcctgtaatctcagcactgtgggaggccgaggtgggtcgactacctgaggttaggagttcgagaccagcctgaccaacatgatgaaacgctgtctctactaaaaatacaaaaattagctaggcgtggtggctgggacctgtaatcccagctacttgggaggctgaggcaggagaatcacttgaaccctggaggtggaggttgcagtgagcagagatctcaccattacactccagcctgggtgacaagagcaaaactgcatctcaaaaaaaaaaaaaaagggggtgaacttgaaggcaggtcctgtgtccatcttttcagattctgtatcccagcacttaggacatagacaaacacgaagatgacaatcaatatttgccaaaatgaaaaaacaaaagaaacatgtaacatcatgtaaaagaagctggttaggtggagaaatttatttaccatagtcttgcttgtggatccagtagtgacttttacagtttatatctaaatagaagctggaggctttgttggggactcataggcataaaatattatttattatagagttaaatgctacaaagacaaatctaattaataggcctattttcctttttaaattctactcataatttcttcatagtttttatgataaaaggttggattttgattagaactcccatgattttgtgtcagaattaaaactggtattagaataaataattcaaaagctagagaaagagtacaaagagaagccatgagttgcatttgaattataatattatgtcttacagatttggggtatatgctaaagttaccaaagttgtagaaaataaggccgggcattgtggctcacatctgtaattccagcactttgggaggccgaggtgggcggatcatttgaggtcaggagttcgagaccagcctggccaacatggtgaaactccgtctgtactaatagtacaaaaattagccaggcgtgatggtgtgcacctgtagtccttgctactcagaa

SEQ ID NO: 3871 - DNA, 1752 bp, Homo sapiens
agcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataa

SEQ ID NO: 3872 - DNA, 2595 bp, Homo sapiens
gacaaatcttcgttataagtttatcagaaaatgatgatgttatcgaattgggagaatggggaaagttgtggggacagtgataacagagccaaatctctgtctatccaattgtctatcaaaacaggaactcaacggattggagcctactgggcttgagagccccgctgaggagtccggaggttgggacgcaactactgccgcgtcccctcccggtccccggccacatggcgagcggggcgacaccgaagcagcccacggagctcgaggcgacgctgctgagcctggttccccaaagcggccgcgccactccccgcttccccgcccggctccgggccccaggccctgggacgccgagccaccgccggcgtttcagacgcaaaccccaccgcgaccctgcagcagcctgccccgcctggccgccagaggcaccttccaactccgaaacacatttttcaacatataatagaatcattatcagaggtggacacatttagaagttgttcttaatcagagggcagcttgtgcttaggaaagccagcctcagtcctcagcacccagcacccagtgctgcaggtttctcctgggtgaagatggaccagcccaccttggccctccggcaagctagaacaatatgtacacgtctctcaaactatgaagagaagatttgggaggagtatgagaaaatcctcaataccaaactagcagagcaatacgagtcgtttgtgaaattcacacatgagcagattatgcgaccatgtgggacaagcccaacaaactatgtgtcttgaagctttttgttgcagatctcggtaccaggtttgacctcaaggcatggttgctatacattttttgcaactgtttgatatcacatttcagctccaactttgcatcctgagaacattccaacgtttctgcaggtccattttatacgacttgaaagaccttaaaactttctggttgccacaggtatatctttcttttctgttcatccagtaaatagtcataccctactgtgacagatttttccaaacaaaaatacctggagcagcagtgtagcaaaatatgccttcagtggcactcaacaaatggagtttccccaagcacagttctgtaagaagtgtgtgtgagagtgtgtatgtgtctgtacatgtactttagattatggtttgtattgtgcaaatttttttgatcttggggattctggctgtggatttgatgcagaaaattatggttaaaaactatggtctacagaagatacttaatgctttgtgactatataaattgtaacagtggattgttttatgtgtaggtattattgttaaatatggggactgttcaccaggcacaaaataggaatcataaattaggatgcaggctgggtatggtggctcatgcctgtaatcccagcactttgggaggaggccgagctgggcggatcgcttgaggagagttcgtgatcagcctggccaacgtggagaaaccctgtccctactaaaaatacaaaaattaggtggacatggtggcgagcacctgtaatcccagcttctcgggaggctgaggcaggagaatcacttgaaccagggaggcagaggttgcagtgagcccagattgtgccactgcactctagcctcggtgacagagtaagattccatctcaaagaaaaaaaaaaaaagtgaagatggccattggctgtggttatgacaatacagtgaaagtctgttgtcttagatatacaaatacatagtgagaaattagaacaaactggagactggcctttgacacatggactctgcctagctgtgttagaaaaatatttaactccaagccttaaaattcccaaatggagttggtgcttacctcattcacacaatccaagagttcactgggtcctgaacctctaaagggaaaaggtctcccctggagcaggagcatcagagtttgctcgggggcataaggtaggtgagtgctgggccgaggcaggctcccctggcactgctagttgcaggagcactttacctttgtatcagttactaaaaacaaaatttgaatcctttggtcaggttcccccaaattattttgaggtagccatgtttaagtgcttgagcttttgtgttggcaaacccctgcccaaggttgctaatagggtattctgccccttgtttccacagctgaggcacagaaagtagcctcttttgtgaggagttgggagttaagtatacatttatttttttaccatgatttgttcaggaccacattttacaagataccttgtttcctttattattgtttctggaaagtcctattcatattattttatttgaatatagaatatagtttttttaaatgagggcttattttgaaaaattctgagcttaattcaaatttatgccaataccttcccaaataaggtaatagtcaaagacagatgttctgatcaaatggcttagagatagtcctggaatattcatattcaaagattccttattaatgaatgtctttaacttaaatctacccaataattgcaacatggttctttgtacattttcattatatggtgttaacaagcttcactgcaaacaaataaattacttaagt

SEQ ID NO: 3873 - DNA, 4333 bp, Homo sapiens
ccatggcgccaccagagggcgcgcgatcccgccccaaccaacttcccgctgaagtgccagaagcagcgaggagcttcaacttcctcagggcagcacgggggtcgtgttaatttggtgttcttcattgatgatgattattccccaccttctaagagacaaagaccaacgagccaccacagccaccagtcccagaacccgccaatgctggggaacggaaaatgagggagttcaactctggccctcacaatccagtggaggagacgaaactcatctgcctctgtccctctgggcacgcctcgtgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatccgtttcctggccgtagaggtggcctgcactcctcagcttgtgctgtccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaatttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccatgttggccgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagctggacctaccatgaaagacttctgaatccaggaagagaaactgactgggcaacatgttattcagaaacaggaccttgccctgtcactcaggatggagttcagtggtcctatcatggctcattatagcctcaaactcccaggctcaagcaatcctaccatgtcagccttcccagtagctgggactacagataccgggtctcacactgtcaccgaggctggagtacagtggcacaacctctgctcactgcagcctccacctgccaggctcaagcaattctcctgcctcagcctcccgagtagctgggattacaggaagtgagctcacaatgactcaagctgccacatactgttgattgtgaaatgccagttgaagcatatgtcctgcgagcttaggggtgctacaagttgaccactgcagcagtaaagatgactctgaagaatggcgtgggatggttcctttcaaatgcacttgagcagcggtctccaaccacagggccacagagctggagctggatctaccatgaaagacttgtgaatccaggaagagagactgactgggcaacatgttattcagaatctccctgtgccatccaggctggagtgcagtgatgtgatcatagctcactatagctttggccttctgagatcaagcaatcctcccatctcaacctcccaagtagctaggactacacatgcatgtcacccatgcccagatcatttttgtagagtcagagtttcaccgtggtggccaggttggccatgttggccagatggggtcttcttttgttgcccaggctggccacaaattcctgggctcaagttatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtagacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgactgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcgtaagaagcaatagtttctcttactattctgagagccttatcattctacatcccatcttcctgtgagtttgtctttgtagcatttaactctaattgcagttctcattttaaaaactggcttgcttattgtatattttccccaactaaagcgtgaactcctagcagggcgtggtggctcatgcctgtaatctcagcactgtgggaggccgaggtgggtcgactacctgaggttaggagttcgagaccagcctgaccaacatgatgaaacgctgtctctactaaaaatacaaaaattagctaggcgtggtggctgggacctgtaatcccagctacttgggaggctgaggcaggagaatcacttgaaccctggaggtggaggttgcagtgagcagagatctcaccattacactccagcctgggtgacaagagcaaaactgcatctcaaaaaaaaaaaaaaagggggtgaacttgaaggcaggtcctgtgtccatcttttcagattctgtatcccagcacttaggacatagacaaacacgaagatgacaatcaatatttgccaaaatgaaaaaacaaaagaaacatgtaacatcatgtaaaagaagctggttaggtggagaaatttatttaccatagtcttgcttgtggatccagtagtgacttttacagtttatatctaaatagaagctggaggctttgttggggactcataggcataaaatattatttattatagagttaaatgctacaaagacaaatctaattaataggcctattttcctttttaaattctactcataatttcttcatagtttttatgataaaaggttggattttgattagaactcccatgattttgtgtcagaattaaaactggtattagaataaataattcaaaagctagagaaagagtacaaagagaagccatgagttgcatttgaattataatattatgtcttacagatttggggtatatgctaaagttaccaaagttgtagaaaataaggccgggcattgtggctcacatctgtaattccagcactttgggaggccgaggtgggcggatcatttgaggtcaggagttcgagaccagcctggccaacatggtgaaactccgtctgtactaatagtacaaaaattagccaggcgtgatggtgtgcacctgtagtccttgctactcagaa

SEQ ID NO: 3874 - DNA, 2364 bp, Homo sapiens
atggccacactcagctgggccctaagctggcgcttccggggcagacagagggcgggcgggccgcgcgagtccagggcgggcgtgtgcttgcgagcggccgcaacgccgcgccgagcccgcgtccccggcgtctgggagcggaggtcgtcagggctgtatgcgtccgacggggacacggggactgcagcaccccggggctggcgtagctgtcgcgagcctgaaggccgcgcctgcgccgtggcggccgaactggcgctcaacagacgggcggggccgagccctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatggcttggaaggggttaccttctcagtgggcagccgcggtcagggctcaggtgtggttttcctctacgttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaaggtggggcacctgctggcgttcttgaacttcctgtacaaatgcataggcaccaccctgggtgctgcttcaagtaaggaggtggtgaggaagcaccttcaagagctgctggagacggccagataccaggaggaggcagaacgcgagtgcgtgctcttccctgcccggggtaagtgtgctgccccccagggcctcgcctgctgcttcgggatctgtgccatctcccacctcgaggacacgctggcccagctggaggacttcgatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggaggcgttcgagagcatcaccagggctccttccctggcctgggccctggacggcagtgggaagaagggaggcgtctgcgcctccgaggggccgggtcgtgggctgtcgccccccagggagttcagccagccccacccgtcccaggacagctggaacctcctctggctctgctccccagtgctcatgggggctgtacctccccggaccccagacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtgtatcctttcctgcctctgcacaggcccgtgcagctgcgtgtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagctggcgcccaagtagataccaggtttccatctgagcccaggatcctgtgcaagggccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgcc

SEQ ID NO: 3875 - DNA, 4336 bp, Homo sapiens
ccatggcgccaccagagggcgcgcgatcccgccccaaccaacttcccgctgaagtgccagaagcagcgaggagcttcaacttcctcagggcagcacgggggtcgtgttaatttggtgttcttcattgatgatgattattccccaccttctaagagacaaagaccaacgagccaccacagccaccagtcccagaacctgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatccgtttcctggccgtagaggtggcctgcactccgcagcttgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaattttttttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccatgttggccgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagctggacctaccatgaaagacttctgaatccaggaagagaaactgactgggcaacatgttattcagaaacaggaccttgccctgtcactcaggatggagttcagtggtcctatcatggctcattatagcctcaaactcccaggctcaagcaatcctaccatgtcagccttcccagtagctggaactacagataccgggtctcacactgtcacccaggctggagtacagtggcacaacctctgctcactgcagcctccacctgccaggctcaagcaattctcctgcctcagcctcccgagtagctgggattacaggaagtgcgctcacaatgactcaagctgccacatactgttgattgtgaaatgccagttgaagcatatgtcctgcaagcttaggggtgctacaagttgaccactgcagcagtaaagatgactctgaagaatggcgtgggatggttcctttcaaatgcacttgagcagcggtctccaaccacagggccacagagctggagctggatctaccatgaaagacttgtgaatccaggaagagagactgactgggcaacatgttattcagaatctccctgtgccatccaggctggagtgcagtgatgtgatcatagctcactatagctttggccttctgagatcaagcaatcctcccatctcaacctcccaagtagctaggactacacatgcatgtcacccatgcccagatcatttttgtagagtcagagtttcaccgtggtggccaggttggccatgttggccagatggggtcttcttttgttgcccaggctggccacaaattcctgggctcaactgatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtagacccacacagatgggatttgggcataggtttggtttcccagggggcagtgctgagctctttgccagtgggaaatgggatgcgggtgatttccagtaggtgacctcacagtgactcaagctaccacttactgttgattgtgacgaaatgccagctgaggcacatgccttgggagctaagtggttgctgccctggaccactgtgaagactggtgtgggaagggtcgctttggatgcacttgagcaggggtccccaacccctgagccatggagccgcaaggagccacacagcaggaggtgggaccatccagttgcaggaaaacaagcttaacacgcccactgattctacattatgctcctacctcccggcagcctctccaggccccgaactttctctagtcagcctctacagaccaagctcatgactctcaatggcctatttaggcccataccctatcacggcagcctccgcagatgaggctactgcctcacaacagcctccacaggcacagctccatcgttacaatggcctctttagacccagctcctgcctcccagccttctctccaggctctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattccagaggggtgacagcgaaacgtgactgcaggacaagttcgagcatcttaaaatgattcaacaggaggagataaggaagctcgaggaagagaaaaaacaactggaaggagaaatcatagatttttataaaatgaaagcttcctctgaagcactgcagactcagctgagcaccgatacaaagaaagacaaacatcgtaagaagcaatagtttctcttactattctgagagccttatcattctacatcccatcttcctgtgagattgtctttgtagcatttaactctaattgcagttctctttttaaaaattggcttgcttattgtatattttccccaactaaagcgtgaactcctagcagggcgtgatggctcatgcctgtaatctcagcactgtgggaggccgaggtgggtcgactacctgaggttaggagttcgagaccagcctgaccaacatgatgaaacgctgtctctactaaaaatacaaaaattagctaggcgtggtggctgggacctgtaatcccagctacttgggaggctgaggcaggagaatcacttgaaccctggaggtggaggttgcagtgagcagagatctcaccattacactccagcctgggtgacaagagcaaaactgcatctcaaaaaaaaaaaaaaaagggggtgaacttgaaggcaggtcctgtgtccatcttttcagattctgtatcccagcacttaggacatagacaaacacgaagatgacaatcaatatttgccaaaatgaaaaaacaaaagaaacatgtaacatcatgtaaaagaagctggttaggtggagaaatttatttaccatagtcttgcttgtggatccagtagtgacttttacagtttatatctaaatagaagctggaggctttgttggggactcataggcataaaatattatttattatagagttaaatgctacaaagacaaatctaattaataggcctattttcctttttaaattctactcataatttcttcatagtttttatgataaaagtttggattttgattagaactcccatgattttgtgtcagaattaaaactggtattagaataaataattcaaaagctagagaaagagtacaaagagaagccatgagttgcatttgaattataatattatgtcttacagatttggggtatatgctaaagttaccaaagttgtagaaaataaggccgggcattgtggctcacatctgtaattccagcactttgggaggccgaggtgggcggatcatttgaggtcaggagtttgagaccagcctggccaacatggtgaaactccgtctgtactaatagtacaaaaattagccaggcgtgatggtgtgcacctgtagtccttgctactcaga

SEQ ID NO: 3876 - DNA, 680 bp, Homo sapiens
cgctgccacgccgacgcagaccccgctctgcacgccagctcgcccgcacccctcatggccacagttcagcagctggaaggaagatggcgcctggtggacagcagaggctttgatgaatatgtgaaggagctaggagtgggaatagctttgcgaaaaatggacacaatagccaagccagattgtatcatcacttgtgatggcaaaaacctcaccataaaaaccgagagcactttgaaaacaacacagttttcttgtaccctgggagagaagtttgaagaaaccacagctgatggcagaaaaactcagactgtgtgcaactttacagatggtgcattggttcaacatcaggagtgggatgggaaggaaaacacaataagaagaaaattgaaagatgggaaattagtggtggactgtgtcatgaacagtgtcacctgtactcggatctatgaaaaagtagaataaaaattccatcatcactttggacaggagttaactaagagaatgaccaagctcagttcaatgagcaaatctccataccgtttctttttttttttttttcattactgtgttcaattatctttatcccaaacattttacatacagctatttcaaagtgtgttggattaattaggatcatccctttggttaataaataaatgtgtttgtgctaataaaaaaaa

SEQ ID NO: 3877 - DNA, 4898 bp, Homo sapiens
gcagaggcagaggctcatggaaaacctctactagggcagtgcacctgtggctttgcaggctttagccccatggctgctctcatgggctgggctggtgttgagtgcctgtagcttttccatactgagggtgtgagctgttggtgggcctatgaatctgggatatggaggatggtggcctcctttttgggggctccaagcccatattttccttctgcactgccatagtggaaatttctcaagaggcttggcctctgcaggaggcttctgcctggaaacagtgggcggtggtgtgggtgcaggatcttcttgatgctgatctcctgatagtgagatctcatgtgatctggttgtctaacagggtgtggtacctctttcctctctgtgtcttgctcctacccctgccatatgaaacatctcattgccacttggccttctggtatgattaggaagggcctggtcagtgtgggcctggtcagtgaactagtcagttgggacttggtcaatgaggcctatttactgggggaatggtcagccagggtctgcttagagagggtctcattagagggatcgagtagtgcaggtcttgttgagtggggacctagtggcagacaaatgtttggtgtctggtcagtgcaaacctgggctgcagggcttggtgagtggagacctggtcagctgtggcttggtggtagccttgtcagaatgggctgggtcactggtgacccggtcaaggggtgctattcagtggaggcctggtcacatgggacctagtcagcagggcatgtcctcatcagtgaggcccttgtcagtgggaccctggtcacggcagcctggtcaggtcagtggaacctaatcagtgggggcctggtcagagaggacttgatcagtggtggcttttgtagcactggtctatggggtgacctgggcaacgggggtctgagcggtacatgcctgttcagtggtgcctagtcactaggtttctggtcaggggcatctggtcaccgcaggcctggttagtaggggcctggtcactggcagcctgttccctggagacctggtcagtggggcttcatctgtggggccaggcaatggggtcatgattgatggaatgtggtcagggaggccttgtcagtaaggccctggtcagtgaggccttgtcagtgaaatccttgtcagtggggtcctggacactgtgggcctggcagcgggaatctagttagtggggcctggtgatgggggcctaatcagtgagggtgtggtcagggaggacctgatgtgcgggatctggtcagcagggacctggtcagtggggctgctgagcactgctgggaggtgtcaggggaaatgcatgttgtcaggggaaatgcatgttatcaggggccctatggacagctgggatggcccagtggtgtccaatggcccagtcaaaagtggacaaagcaggtgtttggatggacctgggagatcttgttcagagattctgaaagaacaaaggtaaaggacgggccagagtggctagagagatggtcacagtctatgggctgcacaggatggaggaagccatggaacaggcagggtgggcagcaggggtgcagggagaggcaggtgcatgctgggagatcggaccctgtgagggctgtgggggcgtcaggtggggtgggctccaggtgcattctcagtgcactgggcaggtctcagtccaggctctctggaccctggtagggtgatgtggtcactccctgggggactgctgtcaggcccagccacccacccttggcagcagtgtcccatctctggactggactttctcagatcctgcagaggacacagcctccagcccagaaggggcagccccttggtgcagcccaagctctccatgggcctggagcatccctgccagccctgtgctccatctactcccaggtcccgcttttcaagtgtcagccagcagagaggctccgtcctcccttccctatgtgtctcctgggctgaaacttggggcgcattgggacagggattgtgctttcctcaggcccatttagggaggagactggctcccagcctggcacaggtcctcagctctgccttggttgccttagagtgacatggatcagtcagtgccctgaaggtaaatggaagagactgtccctgctgtgtgggaggctggtctagggatggaggacttggcaggtcctcccagtctgtcaggcctggacagcactgtcctgtctcaggactcaggaagtctggtcctgggatgggatggtgctgcccagggtgggtggccagggcttgacagcagtcccccaggaagtgaccacatcagccaaccagggtccagggagcctggcctgagacacccacccagtgcattgagggtgcacctggagcccaccccacctgatgcccccacagccctcgcagggtctgacctcccagcatgcacctgcctctccctgcaccccagatgtccaccctgccttttccctgacttcctccatcctgtccagcaggatgggctggtcagtgggacagcctctgtgcacattttgtggcaagtaggagtgacacatcattcctgggaggccccgtggttcctgccaaacccaaccccagaattctccctgaggtggttttaccaaacccataacccagaactgctattgtggtttgggggtcagcacccaccggcgccagggcactactgggaggctgggacctgaccaaagcccatggtgtctgtggcctgaggacagggtgtcttggggccatgaggacaggccaccaatggccgttgggtcatagggcctgagacccagtgtttgtccttccctggctccttctggttcagtcccatcagggctctggatcccaagacacagcatccaaagttccctccaggaatcctggtggcttggcttactttgtcatgtttcatctgatagcaaaaatatcagatcggctgcacagaaaaaaatggctcaaagtgcttaatgaccagaagaaatctaggagcagcaagaaggtaatgtggagaggggaggacctccatgaccggtgtccgtagagccaggggtacaggcacccagtgcagtgacctggcaccacctgcctctcagagggtgggtagcacactgtccttacctgggggacagcaggcctggtcaccagcttttctccctgtccctgcaagcatcacattgctggaagagaatttcatgccagagcttggaccatccctagcttgggggttaggggttgtctcttggtgacctaaatgaaaaaataggtccagatcagagttcctgatgcatagcactcacccactctttgaatcatgggaggggaggcctagtcctaggtaaacctaaactctttgaggaaccacagagcccaaggctggaaacctccagaatcctccagcccccgatcctccccggggactgctgtggcctgtctcaccagagcactcttctgtctgtagatgtctcagctgctctacaagggagtcctatttcaggtgtggggctgggtatggtcactcctgctggatgtctagaaggtgaaaaccaaggacctaggaaaataccagatacagcctttccaccatcatccagagcaggacaaacacgccaggtggtgtcaggaacctaggtctccagctggagggaatgtcaaccctgcagtgggagcccatcacacatcctaggcacagatgctaatgtaggcaccgcaggaatcccagtgaatatattgccaccatcttggagctcagtgccctcatagtgtaagagcaccagcagatctgcctgtgcacagacttcctgtactacctcactcctgaggggagatgcttctgcagggcctgcgacctggggcacaactttagacaccatcatcctggagcggcactgcaccctcactagccagggtgttgatgacttcctcaatgccaaggccacgttcaagattttcgacttcagtgatgcgtttgtgctgagcaagccaagagacccaagcctgcctggctgccacttaggatatgacagcacagccagtggcctctactggatcctggtacccctcagaagacacccagacactgggagtgctgccacctcgtggtgcaagagttctgagggatggcaattctgaagacatttaatgccattttgcacaccctggtcagaatgaaacattccttgggaactcgggccgtgagaagcatccttcctgatcacctgactgtagaaacatccttatcgcaccctcccgggcaaaggcccaacagcctgactgcaggaacatccttgccatatcctgccgggcagcaagctctacagcccagacccctccttcccagtcccatgatcaccccagcctgtgagaggcagttggtgctggcagtaagctggtttcctcctctgcagggttttgctagtaataaaggtgttgctgttgaagccgccaactgtctttctctgtctttctttaaccctcgccttgccttcaaaatctaacaatagctctacctctccattttaccaaggaggatatgagactcaaggagagcaagagacttacccagaattacagagccagtgagtcacagagcctgaacttgagctcaattcagctgaatccagaactcatgtcttcctgagagtccagggaaggaaaggtggaactgcagccagtgggtgcccacaggcttgtcctaggagaccacatgcagcctcctgggaattgtgtcctcttgggcacaaaagaagaactgctcacctgtgctgcatcagctaagtgtccccattgtcccaaattgttatattttttcaaagttttgttttaataactagatttctcacagctcagtgttgaaaacaaagcacagaggcata

SEQ ID NO: 3878 - DNA, 4543 bp, Homo sapiens
ctacatcactggggcgccatggtgcctggagctgggcagttttctcatcagagtggggactggtaagagtgacctccccgccaggttctgtgtgttgccggctgaagaagggtagctgaaaaattcagacccagcacagtgtttatgttggtcaaaaatagaaaactatgtctggcgcggccgaggcgggaggacccttcaggccaagagcagcctagcaacatggcgcaaccccatctctgtagtcctacctcagccccccagctacttgaacccaaaggttcaaggctccagtgagctatgatcccaccacagcattccagcctgcgagattgagatgatgattattccccaccttctaagagacaaagaccaacgagccaccacagccaccagtcccagaacccgccaatgctggggaacggaaaatgagggagttcaactctggccctcacaatccagtggaggagacgcaactcatctgcctctgtccctctgggcacgcctcatgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatctgtttcctggccgtagaggtggcctgcactcctcagcctgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaattttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccacaccaggctaatttttgtatttttagtggagatgcggtttcaccatgttggccgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagctggacctaccatgaaagacttctgaatccaggaagagaaactgactgggcaacatgttattcagaaacaggaccttgccctgtcactcaggatggagttcagtggtcctatcatggctcattatagcctcaaactcccaggctcaagcaatcctaccatgtcagccttcccagtagctgggactacagataccgggtctcacactgtcacccaggctggagtacagtggcacaacctctgctcactgcagcctccacctgccaggctcaagcaattctcctgcctcagcctcccgagtagctgggattacaggaagtgagctcacaatgactcaagctgccacatactgttgattgtgaaatgccagttgaagcatatgtcctgcgagcttgggggtgctacaagttgaccactgcagcagtaaagatgactctgaagaatggcgtgggatggttcctttcaaatgcacttgagcagcggtctccaaccacagggccacagagctggagctggatctaccatgaaagacttgtgaatccaggaagagagactgactgggcaacatgttattcagaatctccctgtgccatccaggctggagtgcagtgatgtgatcatagctcactatagctttggccttctgagatcaagcaatcctcccatctcaacctcccaagtagctaggactacacatgcatgtcacccatgcccagatcatttttgtagagtcagagtttcaccgtggtggccaggttggccatgttggccagatggggtcttcttttgttgcccaggctggccacaaattcctgggctcaagtgatcctcccacctcttccttgtagagatgagatttagttacgtcgtccaggctgatctcaaactcctgggctaaatcgattgtctcacctcagcctctcaagtttgttatgaaggttatatgttaggaagggtcccaggaggtagacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattccagaggggtgacagcgaaacgtgactgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcgtaagaagcaatagtttctcttactattctgagagccttatcattctacatcccatcttcctgtgagtttgtctttgtagcatttaactctaattgcagttctcattttaaaaactggcttgcttattgtatattttccccaactaaagcgtgaactcctagcagggcgtggtggctcatgcctgtaatctcagcactgtgggaggccgaggtgggtcgactacctgaggttaggagttcgagaccagcctgaccaacatgatgaaacgctgtctctactaaaaatacaaaaattagctaggcgtggtggctgggacctgtaatcccagctacttgggaggctgaggcaggagaatcacttgaaccctggaggtggaggttgcagtgagcagagatctcaccattacactccagcctgggtgacaagagcaaaactgcatctcaaaaaaaaaaaaaaaagggggtgaacttgaaggcaggtcctgtgtccatcttttcagattctgtatcccagcacttaggacatagacaaacacgaagatgacaatcaatatttgccaaaatgaaaaaacaaaagaaacatgtaacatcatgtaaaagaagctggttaggtggagaaatttatttaccatagtcttgcttgtggatccagtagtgacttttacagtttgtatctaaatagaagctggaggctttgttggggactcataggcataaaatattatttattatagagttaaatgctacaaagacaaatctaattaataggcctattttcctttttaaattctactcataatttcttcatagtttttatgataaaaggttggattttgattagaactcccatgattttgtgtcagaattaaaactggtattagaataaataattcaaaagctagagaaagagtacaaagagaagccatgagttgcatttgaattataatattatgtcttacagatttggggtatatgctaaagttaccaaagttgtagaaaataaggccgggcattgtggctcacatctgtaattccagcactttgggaggccgaggtgggcggatcatttgaggtcaggagtttgagaccagcctggccaacatggtgaaactccgtctgtactaatagtacaaaaattagccaggcgtgatggtgtgcacctgtagtccttgctactcagaa

SEQ ID NO: 3879 - DNA, 4244 bp, Homo sapiens
atggttccttcagtaatgaccattttttctttttcaagatgatgattattccccaccttctaagagacaaagaccaacgagccaccacagccaccagtcccagaacccgccaatgctggggaacggaaaatgagggagttcaactctggccctcacaatccagtggaggagacgcaactcatctgcctctgtccctctgggcacgcctcatgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatctgtttcctggccgtagaggtggcctgcactcctcagcctgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaattttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccacaccaggctaatttttgtatttttagtggagatgcggtttcaccatgttggccgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagctggacctaccatgaaagacttctgaatccaggaagagaaactgactgggcaacatgttattcagaaacaggaccttgccctgtcactcaggatggagttcagtggtcctatcatggctcattatagcctcaaactcccaggctcaagcaatcctaccatgtcagccttcccagtagctgggactacagataccgggtctcacactgtcacccaggctggagtacagtggcacaacctctgctcactgcagcctccacctgccaggctcaagcaattctcctgcctcagcctcccgagtagctgggattacaggaagtgagctcacaatgactcaagctgccacatactgttgattgtgaaatgccagttgaagcatatgtcctgcgagcttgggggtgctacaagttgaccactgcagcagtaaagatgactctgaagaatggcgtgggatggttcctttcaaatgcacttgagcagcggtctccaaccacagggccacagagctggagctggatctaccatgaaagacttgtgaatccaggaagagagactgactgggcaacatgttattcagaatctccctgtgccatccaggctggagtgcagtgatgtgatcatagctcactatagctttggccttctgagatcaagcaatcctcccatctcaacctcccaagtagctaggactacacatgcatgtcacccatgcccagatcatttttgtagagtcagagtttcaccgtggtggccaggttggccatgttggccagatggggtcttcttttgttgcccaggctggccacaaattcctgggctcaagtgatcctcccacctcttccttgtagagatgagatttagttacgtcgtccaggctgatctcaaactcctgggctaaatcgattgtctcacctcagcctctcaagtttgttatgaaggttatatgttaggaagggtcccaggaggtagacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattccagaggggtgacagcgaaacgtgactgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcgtaagaagcaatagtttctcttactattctgagagccttatcattctacatcccatcttcctgtgagtttgtctttgtagcatttaactctaattgcagttctcattttaaaaactggcttgcttattgtatattttccccaactaaagcgtgaactcctagcagggcgtggtggctcatgcctgtaatctcagcactgtgggaggccgaggtgggtcgactacctgaggttaggagttcgagaccagcctgaccaacatgatgaaacgctgtctctactaaaaatacaaaaattagctaggcgtggtggctgggacctgtaatcccagctacttgggaggctgaggcaggagaatcacttgaaccctggaggtggaggttgcagtgagcagagatctcaccattacactccagcctgggtgacaagagcaaaactgcatctcaaaaaaaaaaaaaaaagggggtgaacttgaaggcaggtcctgtgtccatcttttcagattctgtatcccagcacttaggacatagacaaacacgaagatgacaatcaatatttgccaaaatgaaaaaacaaaagaaacatgtaacatcatgtaaaagaagctggttaggtggagaaatttatttaccatagtcttgcttgtggatccagtagtgacttttacagtttgtatctaaatagaagctggaggctttgttggggactcataggcataaaatattatttattatagagttaaatgctacaaagacaaatctaattaataggcctattttcctttttaaattctactcataatttcttcatagtttttatgataaaaggttggattttgattagaactcccatgattttgtgtcagaattaaaactggtattagaataaataattcaaaagctagagaaagagtacaaagagaagccatgagttgcatttgaattataatattatgtcttacagatttggggtatatgctaaagttaccaaagttgtagaaaataaggccgggcattgtggctcacatctgtaattccagcactttgggaggccgaggtgggcggatcatttgaggtcaggagtttgagaccagcctggccaacatggtgaaactccgtctgtactaatagtacaaaaattagccaggcgtgatggtgtgcacctgtagtccttgctactcagaa

SEQ ID NO: 3880 - DNA, 4898 bp, Homo sapiens
gcagaggcagaggctcatggaaaacctctactagggcagtgcacctgtggctttgcaggctttagccccatggctgctctcatgggctgggctggtgttgagtgcctgtagcttttccatactgagggtgtgagctgttggtgggcctatgaatctgggatatggaggatggtggcctcctttttgggggctccaagcccatattttccttctgcactgccatagtggaaatttctcaagaggcttggcctctgcaggaggcttctgcctggaaacagtgggcggtggtgtgggtgcaggatcttcttgatgctgatctcctgatagtgagatctcatgtgatctggttgtctaacagggtgtggtacctctttcctctctgtgtcttgctcctacccctgccatatgaaacatctcattgccacttggccttctggtatgattaggaagggcctggtcagtgtgggcctggtcagtgaactagtcagttgggacttggtcaatgaggcctatttactgggggaatggtcagccagggtctgcttagagagggtctcattagagggatcgagtagtgcaggtcttgttgagtggggacctagtggcagacaaatgtttggtgtctggtcagtgcaaacctgggctgcagggcttggtgagtggagacctggtcagctgtggcttggtggtagccttgtcagaatgggctgggtcactggtgacccggtcaaggggtgctattcagtggaggcctggtcacatgggacctagtcagcagggcatgtcctcatcagtgaggcccttgtcagtgggaccctggtcacggcagcctggtcaggtcagtggaacctaatcagtgggggcctggtcagagaggacttgatcagtggtggcttttgtagcactggtctatggggtgacctgggcaacgggggtctgagcagtacatgcctgttcagtggtgcctagtcactaggtttctggtcaggggcatctggtcaccgcaggcctggttagtaggggcctggtcactggcagcctgttccctggagacctggtcagtggggcttcatctgtggggccaggcaatggggtcatgattgatggaatgtggtcagggaggccttgtcagtaaggccctggtcagtgaggccttgtcagtgaaatccttgtcagtggggtcctggacactgtgggcctggcagcgggaatctagttagtggggcctggtgatgggggcctaatcagtgagggtgtggtcagggaggacctgatgtgcgggatctggtcagcagggacctggtcagtggggctgctgagcactgctgggaggtgtcaggggaaatgcatgttgtcaggggaaatgcatgttatcaggggccctatggacagctgggatggcccagtggtgtccaatggcccagtcaaaagtggacaaagcaggtgtttggatggacctgggagatcttgttcagagattctgaaagaacaaaggtaaaggacgggccagagtggctagagagatggtcacagtctatgggctgcacaggatggaggaagccatggaacaggcagggtgggcagcaggggtgcagggagaggcaggtgcatgctgggagatcggaccctgtgagggctgtgggggcgtcaggtggggtgggctccaggtgcattctcagtgcactgggcaggtctcagtccaggctctctggaccctggtagggtgatgtggtcactccctgggggactgctgtcaggcccagccacccacccttggcagcagtgtcccatctctggactggactttctcagatcctgcagaggacacagcctccagcccagaaggggcagccccttggtgcagcccaagctctccatgggcctggagcatccctgccagccctgtgctccatctactcccaggtcccgcttttcaagtgtcagccagcagagaggctccgtcctcccttccctatgtgtctcctgggctgaaacttggggcgcattgggacagggattgtgctttcctcaggcccatttagggaggagactggctcccagcctggcacaggtcctcagctctgccttggttgccttagagtgacatggatcagtcagtgccctgaaggtaaatggaagagactgtccctgctgtgtgggaggctggtctagggatggaggacttggcaggtcctcccagtctgtcaggcctggacagcactgtcctgtctcaggactcaggaagtctggtcctgggatgggatggtgctgcccagggtgggtggccagggcttgacagcagtcccccaggaagtgaccacatcagccaaccagggtccagggagcctggcctgagacacccacccagtgcattgagggtgcacctggagcccaccccacctgatgcccccacagccctcgcagggtctgacctcccagcatgcacctgcctctccctgcaccccagatgtccaccctgccttttccctgacttcctccatcctgtccagcaggatgggctggtcagtgggacagcctctgtgcacattttgtggcaagtaggagtgacacatcattcctgggaggccccgtggttcctgccaaacccaaccccagaattctccctgaggtggttttaccaaacccataacccagaactgctattgtggtttgggggtcagcacccaccggcgccagggcactactgggaggctgggacctgaccaaagcccatggtgtctgtggcctgaggacagggtgtcttggggccatgaggacaggccaccaatggccgttgggtcatagggcctgagacccagtgtttgtccttccctggctccttctggttcagtcccatcagggctctggatcccaagacacagcatccaaagttccctccaggaatcctggtggcttggcttactttgtcatgtttcatctgatagcaaaaatatcagatcggctgcacagaaaaaaatggctcaaagtgcttaatgaccagaagaaatctaggagcagcaagaaggtaatgtggagaggggaggacctccatgaccggtgtccgtagagccaggggtacaggcacccagtgcagtgacctggcaccacctgcctctcagagggtgggtagcacactgtccttacctgggggacagcaggcctggtcaccagcttttctccctgtccctgcaagcatcacattgctggaagagaatttcatgccagagcttggaccatccctagcttgggggttaggggttgtctcttggtgacctaaatgaaaaaataggtccagatcagagttcctgatgcatagcactcacccactctttgaatcatgggaggggaggcctagtcctaggtaaacctaaactctttgaggaaccacagagcccaaggctggaaacctccagaatcctccagcccccgatcctccccggggactgctgtggcctgtctcaccagagcactcttctgtctgtagatgtctcagctgctctacaagggagtcctatttcaggtgtggggctgggtatggtcactcctgctggatgtctagaaggtgaaaaccaaggacctaggaaaataccagatacagcctttccaccatcatccagagcaggacaaacacgccaggtggtgtcaggaacctaggtctccagctggagggaatgtcaaccctgcagtgggagcccatcacacatcctaggcacagatgctaatgtaggcaccgcaggaatcccagtgaatatattgccaccatcttggagctcagtgccctcatagtgtaagagcaccagcagatctgcctgtgcacagacttcctgtactacctcactcctgaggggagatgcttctgcagggcctgcgacctggggcacaactttagacaccatcatcctggagcggcactgcaccctcactagccagggtgttgatgacttcctcaatgccaaggccacgttcaagattttcgacttcagtgatgcgtttgtgctgagcaagccaagagacccaagcctgcctggctgccacttaggatatgacagcacagccagtggcctctactggatcctggtacccctcagaagacacccagacactgggagtgctgccacctcgtggtgcaagagttctgagggatggcaattctgaagacatttaatgccattttgcacaccctggtcagaatgaaacattccttgggaactcgggccgtgagaagcatccttcctgatcacctgactgtagaaacatccttatcgcaccctcccgggcaaaggcccaacagcctgactgcaggaacatccttgccatatcctgccgggcagcaagctctacagcccagacccctccttcccagtcccatgatcaccccagcctgtgagaggcagttggtgctggcagtaagctggtttcctcctctgcagggttttgctagtaataaaggtgttgctgttgaagccgccaactgtctttctctgtctttctttaaccctcgccttgccttcaaaatctaacaatagctctacctctccattttaccaaggaggatatgagactcaaggagagcaagagacttacccagaattacagagccagtgagtcacagagcctgaacttgagctcaattcagctgaatccagaactcatgtcttcctgagagtccagggaaggaaaggtggaactgcagccagtgggtgcccacaggcttgtcctaggagaccacatgcagcctcctgggaattgtgtcctcttgggcacaaaagaagaactgctcacctgtgctgcatcagctaagtgtccccattgtcccaaattgttatattttttcaaagttttgttttaataactagatttctcacagctcagtgttgaaaacaaagcacagaggcata

SEQ ID NO: 3881 - DNA, 1366 bp, Homo sapiens
atgttggcgaccttgctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcgtaagaagcaatagtttctcttactattctgagagccttatcattctacatcccatcttcctgtgagtttgtctttgtagcatttaactctaattgcagttctcattttaaaaactggcttgcttattgtatattttccccaactaaagcgtgaactcctagcagggcgtggtggctcatgcctgtaatctcagcactgtgggaggccgaggtgggtcgactacctgaggttaggagttcgagaccagcctgaccaacatgatgaaacgctgtctctactaaaaatacaaaaattagctaggcgtggtggctgggacctgtaatcccagctacttgggaggctgaggcaggagaatcacttgtaccctggaggtggaggttgcagtgagcagagatctcaccattacactccagcctgggtgacaagagcaaaactgcatctcaaaaaaaaaaaaaaaagggggtgaacttgaaggcaggtcctgtgtccatcttttcagattctgtatcccagcacttaggacatagacaaacacgaagatgacaatcaatatttgccaaaatgaaaaaacaaaagaaacatgtaacatcatgtaaaagaagctggttaggtggagaaatttatttaccatagtcttgcttgtggatccagtagtgacttttacagtttatatctaaatagaagctggaggctttgttggggactcataggcataaaatattatttattatagagttaaatgctacaaagacaaatctaattaataggcctattttcctttttaaattctactcataatttcttcatagtttttatgataaaaggttggattttgattagaactcccatgattttgtgtcagaattaaaactggtattagaataaataattcaaaagctagagaaagagtacaaagagaagccatgagttgcatttgaattataatattatgtcttacagatttggggtatatgctaaagttaccaaagttgtagaaaataaggccgggcattgtggctcacatctgtaattccagcactttgggaggccgaggtgggcggatcatttgaggtcaggagtttgagaccagcctggccaacatggtgaaactccgtctgtactaatagtacaaaaattagcgaggcgtgatggtgtgcacctgtagtccttgctactcagaa

SEQ ID NO: 3882 - DNA, 2595 bp, Homo sapiens; identical to SEQ ID NO: 3872

SEQ ID NO: 3883 - DNA, 680 bp, Homo sapiens
cgctgccacgccgacgcagaccccgctctgcacggcagctcgcccgcacccctcatggccacagttcagcagctggaaggaagatggcgcctggtggacagcagaggctttgatgaatatgtgaaggagctaggagtgggaatagctttgcgaaaaatggacacaatagccaagccagattgtatcatcacttgtgatggcaaaaacctcaccataaaaaccgagagcactttgaaaacaacacagttttcttgtaccctgggagagaagtttgaagaaaccacagctgatggcagaaaaactcagactgtgtgcaactttacagatggtgcattggttcaacatcaggagtgggatgggaaggaaaacacaataagaagaaaattgaaagatgggaaattagtggtggactgtgtcatgaacagtgtcacctgtactcggatctatgaaaaagtagaataaaaattccatcatcactttggacaggagttaactaagagaatgaccaagctcagttcaatgagcaaatctccataccgtttctttttttttttttttcattactgtgttcaattatctttatcccaaacattttacatacagctatttcaaagtgtgttggattaattaggatcatccctttggttaataaataaatgtgtttgtgctaataaaaaaaa

SEQ ID NO: 3884 - DNA, 2595 bp, Homo sapiens; identical to SEQ ID NO: 3872

SEQ ID NO: 3885 - DNA, 6267 bp, Homo sapiens
gcacaacctctgctcactgcagcctccacctgccaggctcaagcaattctcctgcctcagcctcccgagtagctgggattacaggtaagtgccaccacacccagctgatttttgtgttttttgtagagacgaggtttcgccatgtttcccagactgttctcaaactcctgagctcaaagcagtccacccaccttggcctcccagagttctgggattacaggtgtgagccatcttgctcattctagtttaaacttttgagtggtttgtgtctcctgattggactcctacaaatacagaattgatgctaggaagggtaccaggagatagacgcacacagatgggatttgggaataggtttggttatccaaggagcagtgctgagctccttgcaatgggatatgggatgctggtgatttccaggatgtgagctcacaatgactcaagctgccacatactgttgattgtgaaatgccagttgaagcatatgtcctgcgagcttaggggtgctacaagttgaccactgcagcagtaaagatgactctgaagaatggcgtgggttggttcctttcaaatgcacttgagcagcggtctccaaccacagggccacagagctggagctggatctaccatgaaagacttgtgaatccaggaagagagactgactgggcaacatgttattcaggtgggaacatccagttgcaggaaaacaagcttaacacgcccactgattctacattatgggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattctagaggggtgacagcgaaacgtgggaccatccagttgcaggaaaacaagcttgacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcccgcctgccagtggcctcttcaggcccatggggctcattcctgacaacggcctttccaggcccagtttttcccttccggcggcctctccgggcccagaacctcctcaagtcagcctctccagacccacttgcaccctccgggcgttctctccgggcccagctcttcttcctggttgggtctccaggcccgattcctgcctctcaacaacctctttggactcagtgcctacccatctcctggcggccttggtcggcccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgactgccgcaggcccaagttgtcctgaagtcgggctctcccggccctgcctcccagcaagtaagcaagctcttttggctcaactcctgcccagctcccaaccgcctttgtaggccccgaactttctccagccaagctctgagggcccacctcctgcctcctggtggcctgtacagttctagcactggttggagaacagcctctgcaggccccgccttgcctcccaggggcctctccaggccaagctcttgcacccacggcggcctcccggggcaagtcccctgctgggaggtaggcagggacttgggcctgggaggtcgcggtggggcgagagctgggcctggagactcccctgggaggcaacagcggggtctgcagacgcccttctccagccggagctgggactgttcagtcactgggagaagggatgtgggtctgaagagcttggttgcagaaacttcggggtctacaaacgcaggcgggagctgagccaaaagagcttgtttgctgggaggtgggagatgcagccaggaggaacagctgggcaatgcgggaggcagagccaggcctcctcaagttggcctctcagacccacttgcagcctcccggcgccccctccgggcccagctcttcctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcagcccagcccagctcatggctctcggcggccttcgcaggccctgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatgttttggtaggtaatttatttggagtgagtttctgcgtcaagcccgagttttttattttattttccttattatttggtgttaaacaggtttaatgacggtcatggcaactttttggcacaatgaaaaatgtcgcccacgatcaacgtgttctgttctggggaagggggcaaaggcagggtgaatcactttcttaaaaagtatagctcaagttgggagtgcagagggaatggggagaaaaccctcccgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacaatgtcaggagatcgaaatcagcctggccaagatgatgaagccccgtctgtactaaaaatacaaaaattagccggacgtggtagcgtctacctgtaatcctagctacccggaaggctgaggcaggagaatggcgtgaacccggcgggaagaggttgcagtgagccaagatcgcaccactgcactccagcctgggcgacagagcaagactcggtctcaaaaaaaaaaaaaaaaaaaaaaaaaaaaaaaaagaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggccccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcagtggtggggcagccagggcagcgtcaagagtctgagccagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcgtaagaagcaatagtttctcttactattctgagagccttatcattctacatcccatcttcctgtgagtttgtctttgtagcatttaactctaattgcagttctcattttaaaaactggcttgcttattgtatattttccccaactaaagcgtgaactcctagcagggcgtggtggctcatgcctgtaatctcagcactgtgggaggccgaggtgggtcgactacctgaggttaggagttcgagaccagcctgaccaacatgatgaaacgctgtctctactaaaaatacaaaaattagctaggcgtggtggctgggacctgtaatcccagctacttgggaggctgaggcaggagaatcacttgaaccctggaggtggaggttgcagtgagcagagatctcaccattacactccagcctgggtgacaagagcaaaactgcatctcaaaaaaaaaaaaaaaagggggtgaacttgaaggcaggtcctgtgtccatcttttcagattctgtatcccagcacttaggacatagacaaacacgaagatgacaatcaatatttgccaaaatgaaaaaacaaaagaaacatgtaacatcatgtaaaagaagctggttaggtggagaaatttatttaccatagtcttgcttgtggatccagtagtgacttttacagtttatatctaaatagaagctggaggctttgttggggactcataggcataaaatattatttattatagagttaaatgctacaaagacaaatctaattaataggcctattttcctttttaaattctactcataatttcttcatagtttttatgataaaaggttggattttgattagaactcccatgattttgtgtcagaattaaaactggtattagaataaataattcaaaagctagagaaagagtacaaagagaagccatgcattgcatttgaattataatattatgtcttacagatttggggtatatgctaaagttaccaaagttgtagaaaataaggccgggcattgtggctcacatctgtaattccagcactttgggaggccgaggtgggcggatcatttgaggtcaggagtttgagaccagcctggccaacatggtgaaactccgtctgtactaatagtacaaaaattagccaggcgtgatggtgtgcacctgtagtccttgctactcagaa

SEQ ID NO: 3886 - DNA, 6500 bp, Homo sapiens
gcacaacctctgctcactgcagcctccacctgccaggctcaagcaattctcctgcctcagcctcccgagtagctgggattacaggtaagtgccaccacacccagctgatttttgtgttttttgtagagacgaggtttcgccatgtttcccagactgttctcaaactcctgagctcaaagcagtccacccaccttggcctcccagagttctgggattacaggtgtgagccatcttgctcattctagtttaaacttttgagtggtttgtgtctcctgattggactcctacaaatacagaattgatgctaggaagggtaccaggagatagacgcacacagatgggatttgggaataggtttggttatccaaggagcagtgctgagctccttgcaatgggatatgggatgctggtgatttccaggatgtgagctcacaatgactcaagctgccacatactgttgattgtgaaatgccagttgaagcatatgtcctgcgagcttaggggtgctacaagttgaccactgcagcagtaaagatgactctgaagaatggcgtgggttggttcctttcaaatgcacttgagcagcggtctccaaccacagggccacagagctggagctggatctaccatgaaagacttgtgaatccaggaagagagactgactgggcaacatgttattcaggtgggaacatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattctagaggggtgacagcgaaacgtgggaccatccagttgcaggaaaacaagcttgacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcccgcctgccagtggcctcttcaggcccatggggctcattcctgacaacggcctttccaggcccagtttttcccttccggcggcctctccgggcccagaacctcctcaagtcagcctctccagacccacttgcaccctccgggcgttctctccgggcccagctcttcttcctggttgggtctccaggcccgattcctgcctctcaacaacctctttggactcagtgcctacccatctcctggcggccttggtcggcccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgactgccgcaggcccaagttgtcctgaagtcgggctctcccggccctgcctcccagcaagtaagcaagctcttttggctcaactcctgcccagctcccaaccgcctttgtaggccccgaactttctccagccaagctctgagggcccacctcctgcctcctggtggcctgtacagttctagcactggttggagaacagcctctgcaggccccgccttgcctcccaggggcctctccaggccaagctcttgcacccacggcggcctcccggggcaagtcccctgctgggaggtaggcagggacttgggcctgggaggtcgcggtggggcgagagctgggcctggagactcccctgggaggcaacagcggggtctgcagacgcccttctccagccggagctgggactgttcagtcactgggagaagggatgtgggtctgaagagcttggttgcagaaacttcggggtctacaaacgcaggcgggagctgagccaaaagagcttgtttgctgggaggtgggagatgcagccaggaggaacagctgggcaatgcgggaggcagagccaggcctcctcaagttggcctctcagacccacttgcagcctcccggcgccccctccgggcccagctcttcctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcagcccagcccagctcatggctctcggcggccttcgcaggccctgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatgttttggtaggtaatttatttggagtgagtttctgcgtcaagcccgagttttttattttattttccttattatttggtgttaaacaggtttaatgacggtcatggcaactttttggcacaatgaaaaatgtcgcccacgatcaacgtgttctgttctggggaagggggcaaaggcagggtgaatcactttcttaaaaagtatagctcaagttgggagtgcagagggaatggggagaaaaccctcccgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacaatgtcaggagatcgaaatcagcctggccaagatgatgaagccccgtctgtactaaaaatacaaaaattagccggacgtggtagcgtctacctgtaatcctagctacccggaaggctgaggcaggagaatggcgtgaacccggcgggaagaggttgcagtgagccaagatcgcaccactgcactccagcctgggcgacagagcaagactcggtctcaaaaaaaaaaaaaaaaaaaaaaaaaaaaaaaaagaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggccccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcagtggtggggcagccagggcagcgtcaagagtctgagccagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcgtaagaagcaatagtttctcttactattctgagagccttatcattctacatcccatcttcctgtgagtttgtctttgtagcatttaactctaattgcagttctcattttaaaaactggcttgcttattgtatattttccccaactaaagcgtgaactcctagcagggcgtggtggctcatgcctgtaatctcagcactgtgggaggccgaggtgggtcgactacctgaggttaggagttcgagaccagcctgaccaacatgatgaaacgctgtctctactaaaaatacaaaaattagctaggcgtggtggctgggacctgtaatcccagctacttgggaggctgaggcaggagaatcacttgaaccctggaggtggaggttgcagtgagcagagatctcaccattacactccagcctgggtgacaagagcaaaactgcatctcaaaaaaaaaaaaaaaagggggtgaacttgaaggcaggtcctgtgtccatcttttcagattctgtatcccagcacttaggacatagacaaacacgaagatgacaatcaatatttgccaaaatgaaaaaacaaaagaaacatgtaacatcatgtaaaagaagctggttaggtggagaaatttatttaccatagtcttgcttgtggatccagtagtgacttttacagtttatatctaaatagaagctggaggctttgttggggactcataggcataaaatattatttattatagagttaaatgctacaaagacaaatctaattaataggcctattttcctttttaaattctactcataatttcttcatagtttttatgataaaaggttggattttgattagaactcccatgattttgtgtcagaattaaaactggtattagaataaataattcaaaagctagagaaagagtacaaagagaagccatgcattgcatttgaattataatattatgtcttacagatttggggtatatgctaaagttaccaaagttgtagaaaataaggccgggcattgtggctcacatctgtaattccagcactttgggaggccgaggtgggcggatcatttgaggtcaggagtttgagaccagcctggccaacatggtgaaactccgtctgtactaatagtacaaaaattagccaggcgtgatggtgtgcacctgtagtccttgctactcagaa

SEQ ID NO: 3887 - DNA, 7573 bp, Homo sapiens
tgcatgctggatgcagtggctcatgcctgtaatctcagcactttgggaggccaaggtgggaggatcgcttaaactcaggagtttgagaccagcctgggcaacatggtgaaaacctgtctctataaaaaattaaaaaataataataataactggtgtggtgttgtgcacctagagttccaactactagggaagctgagatgagaggataccttgagctggggactggggaggcttaggttacagtaagctgagattgtgccactgcactccagcttggacaaaagagcctgatcctgtctcaaaaaaaagaaagatacccagggcaagttaagttcggaggggcacagagctcccatgccctctgttgaacatgcgaccctcccagcatctcctgtgtccagcaaccctgaaagctctgcaaacccctttcagggtgtttatggaggctttattatgcaagcatgattgataaaacctttggctgttggtgattaagtcagtctccagcccctcttccccctggagttcagtgcatgaggctgaaagttccaagcctcttaccatgtggttgcatggtaatcagccctcctcttgaagaaatttaggagcttgcagtcacccagtcatctcaacaacatccccaaatgcattcttaccatgctggagatcccaaagttcttagaggctcttgtgttagaaacctgggaccaagaccaaatattaaaacaaaagatgctcctgtcacatctatcactgaggtctttgtaagagctttagaagctctgtgccaggaaccagggacagagattaaatatatatttcttttcttttttttgagacagaatcttcctgtgccatccaggctggagtgcagtgatgtgatcatagctcactatagctttggccttctgagatcaagcaatcctcccatctcaacctcccaagtagctaggactacacacgcatgtcacccatgcccagatcatttttgtagagtcagagtttcaccgtggtggccaggttggccatgttggccagatggggtcttcttttgttgcccaggctggccacaaattcctgggctcaagtgatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtaaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcattagatgctcataggagaacgcaccctgttgtgaactgtgcatgtgagggatctgggttgcgctgtccttatgagagtctaatacctattgatctgtcactttctcccatcacgctcaggtgggaacatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattctagaggggtgacagcgaaacgtgggaccatccagttgcaggaaaacaagcttgacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcccgcctgccagtggcctcttcaggcccatggggctcattcctgacaacggcctttccaggcccagtttttcccttccggcggcctctccgggcccagaacctcctcaagtcagcctctccagacccacttgcaccctccgggcgttctctccgggcccagctcttcttcctggttgggtctccaggcccgattcctgcctctcaacaacctctttggactcagtgcctacccatctcctggcggccttggtcggcccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgactgccgcaggcccaagttgtcctgaagtcgggctctcccggccctgcctcccagcaagtaagcaagctcttttggctcaactcctgcccagctcccaaccgcctttgtaggccccgaactttctccagccaagctctgagggcccacctcctgcctcctggtggcctgtacagttctagcactggttggagaacagcctctgcaggccccgccttgcctcccaggggcctctccaggccaagctcttgcacccacggcggcctcccggggcaagtcccctgctgggaggtaggcagggacttgggcctgggaggtcgcggtggggcgagagctgggcctggagactcccctgggaggcaacagcggggtctgcagacgcccttctccagccggagctgggactgttcagtcactgggagaagggatgtgggtctgaagagcttggttgcagaaacttcggggtctacaaacgcaggcgggagctgagccaaaagagcttgtttgctgggaggtgggagatgcagccaggaggaacagctgggcaatgcgggaggcagagccaggcctcctcaagttggcctctcagacccacttgcagcctcccggcgccccctccgggcccagctcttcctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcagcccagcccagctcatggctctcggcggccttcgcaggccctgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatgttttggtaggtaatttatttggagtgagtttctgcgtcaagcccgagttttttattttattttccttattatttggtgttaaacaggtttaatgacggtcatggcaactttttggcacaatgaaaaatgtcgcccacgatcaacgtgttctgttctggggaagggggcaaaggcagggtgaatcactttcttaaaaagtatagctcaagttgggagtgcagagggaatggggagaaaaccctcccgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacaatgtcaggagatcgaaatcagcctggccaagatgatgaagccccgtctgtactaaaaatacaaaaattagccggacgtggtagcgtctacctgtaatcctagctacccggaaggctgaggcaggagaatggcgtgaacccggcgggaagaggttgcagtgagccaagatcgcaccactgcactccagcctgggcgacagagcaagactcggtctcaaaaaaaaaaaaaaaaaaaaaaaaaaaaaaaaagaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggccccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcagtggtggggcagccagggcagcgtcaagagtctgagccagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcgtaagaagcaatagtttctcttactattctgagagccttatcattctacatcccatcttcctgtgagtttgtctttgtagcatttaactctaattgcagttctcattttaaaaactggcttgcttattgtatattttccccaactaaagcgtgaactcctagcagggcgtggtggctcatgcctgtaatctcagcactgtgggaggccgaggtgggtcgactacctgaggttaggagttcgagaccagcctgaccaacatgatgaaacgctgtctctactaaaaatacaaaaattagctaggcgtggtggctgggacctgtaatcccagctacttgggaggctgaggcaggagaatcacttgaaccctggaggtggaggttgcagtgagcagagatctcaccattacactccagcctgggtgacaagagcaaaactgcatctcaaaaaaaaaaaaaaaagggggtgaacttgaaggcaggtcctgtgtccatcttttcagattctgtatcccagcacttaggacatagacaaacacgaagatgacaatcaatatttgccaaaatgaaaaaacaaaagaaacatgtaacatcatgtaaaagaagctggttaggtggagaaatttatttaccatagtcttgcttgtggatccagtagtgacttttacagtttatatctaaatagaagctggaggctttgttggggactcataggcataaaatattatttattatagagttaaatgctacaaagacaaatctaattaataggcctattttcctttttaaattctactcataatttcttcatagtttttatgataaaaggttggattttgattagaactcccatgattttgtgtcagaattaaaactggtattagaataaataattcaaaagctagagaaagagtacaaagagaagccatgcattgcatttgaattataatattatgtcttacagatttggggtatatgctaaagttaccaaagttgtagaaaataaggccgggcattgtggctcacatctgtaattccagcactttgggaggccgaggtgggcggatcatttgaggtcaggagtttgagaccagcctggccaacatggtgaaactccgtctgtactaatagtacaaaaattagccaggcgtgatggtgtgcacctgtagtccttgctactcagaa

SEQ ID NO: 3888 - DNA, 1026 bp, Homo sapiens
gaaaagcagagaaagtactagtttgtggaactggcaggttgcatggggtaagatggaaggctaagcaaaaaagctctgtttattctccctaagaattagtctcggcctctcctaaactcccaggtaccttgtacctctagttgagcattaattgctgcatatttacgtattgaaaacttattgcgaggtgacaagagcaatgtgattttaactgtcaaatgatccctccttttcacaatttatacaccttcactttccccaaaaaatgacagaatcccaagcagtcttcatattagagctgctcagtcaagtcctctttaatttgtttgcttctttgctttagaaaacaaatgttgctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaatataaaaaaaaaaaaaaaagaaa

SEQ ID NO: 3889 - DNA, 2774 bp, Homo sapiens
aattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcggaagacccctctccagaagccattctgcatccttgtctgctctgcgtcacccgagaacacaggcttcgcagcctcgctttctgaaatggtgtgtgccgagtcagattgccgctcagagaaaatacaagcccgttttccctagctgtgccatttggtgctctgccaggctgccgtgcaagggaataccgacgagacgagctgcactgtctctgatttggagccctcaccggagcttgtctttaaaaatgagcaggaagctcatgtatgtttgcatttcagtgagccgggtcctgacctgccgccacccatcacggtcagcgtggtgcatcttaccgaggaggcgcaggcctggattcttttgagtggtgctactgcctaggaagtaacacgtggagaatttccatcttgggaccatgcacacagtgccttggggagtagattttgccctaatagcgatgaagaattttatcagtcagtggagttcctttttcagatcagggatgggaaagagccaaactgggtacctcccacgtgtgccccgtgaacagccctttgcagctgggctgtggggcttggctgctgccctgtcccatctggcagttaacgccttctccctgctctgccccccactccccaaaaccagttgcagcctcaacccacatggggatgtagaaagccgtaaagtccacgctactgttgaaaatgtttacatctccgctctcaacctgccttgggttcgtgttaaatggtgttaaattctgcaaatggaggggaaaaaaatcaaattctaaatttcaaagtagaatttaaagcaaatttgtaaaaaaattatcctaccaccccttttggtccacttaagatatgccacgctgaagcaaggtatttcctactggattttgctttcactggtgtttagaaaataaacttgatttctctaggagcactcctttggttagagggatgcaagaaggagaggtgaaggtggcgtgtggtggctcatgcctgtaatcccagcactttggggaggccgaggcaggcggatcacttgaggccagcagtttgagaccagcctggccaacatgatgaaaccccatctctactaaaaatacaaaaaattagctgggcatggtggcaggcacctgtaatcccagttacttgggaggctgaggcaggagaattgcttgaacccaggaggtggaggttgcagtgagctgagattgtgccactgcacttcagcctgggcgacagagtgactctgtcaaaaaggaaaggcaaaaaccggaccctggagctctgtgggccctgattgcaggcccctccctgtgtgatgagggatgagtcagcttggggagccacttggccagcctgcatgcctggtcatcaggaggttgagaaaagccttgaaagttgtgaagcactgagcagatacaagtgtttgttaattttgtagaaattaactttcccatctggcctttatctccaaagttggtattgttgctccacgcagactgcagtccggtttcttattgtgactttgacaatgcaaagtgcaaaataggaagaggcctccccaccccactatcccaccctggtgaccaattcagtgtaacctttgcacgtactcagtcattggtgtctttggagtgacatctgcagccagttagtgccacctgagtacagcactcgtacttttacatgatgtgtgtgtgagtagctcttctgtccaaaccatgatttgaggttcaactacctgtagatcaaagctttattttagaacgataaactgattttttccaaatgggtgaaatcttctccccatgactatgttttcttaactttgcattgaatctatttactgggttacattctatgtgtagtttgctttcttcatttttttttcttttaaaatgctcatgtcttattccaagcaccttcctccaaagtccccataaagctgcatctccaacacattgttatgccaataaggttttatttaactttatttaaggatgattgtgtctttgaatgacaaatgtactgctgcttcctacctgcaagacgaacaatgtatgtttcaagggtgagcaagtgttatttcttaaatttctcaaatgcctgtagtaactattgtttctgcctctcaattgttgccagctctttgaagaaggggagaattgtgtgtttttgtgtggggatgtttctgatatgctgctacagttgcaaaacactggagctagagaaaataaagtactgatc

SEQ ID NO: 3890 - DNA, 1026 bp, Homo sapiens; identical to SEQ ID NO: 3888

SEQ ID NO: 3891 - DNA, 2776 bp, Homo sapiens
aattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcggaagacccctctccagaagccattctgcatccttgtctgctctgcgtcacccgagaacacaggcttcgcagcctcgctttctgaaatggtgtgtgccgagtcagattgccgctcagagaaaatacaagcccgttttccctagctgtgccatttggtgctctgccaggctgccgtgcaagggaataccgacgagacgagctgcactgtctctgatttggagccctcaccggagcttgtctttaaaaatgagcaggaagctcatgtatgtttgcatttcagtgagccgggtcctgacctgccgccacccatcacggtcagcgtggtgcatcttaccgaggaggcgcaggcctggattcttttgagtggtgctactgcctaggaagtaacacgtggagaatttccatcttgggaccatgcacacagtgccttggggagtagattttgccctaatagcgatgaagaattttatcagtcagtggagttcctttttcagatcagggatgggaaagagccaaactgggtacctcccacgtgtgccccgtgaacagccctttgcagctgggctgtggggcttggctgctgccctgtcccatctggcagttaacgccttctccctgctctgccccccactccccaaaaccagttgcagcctcaacccacatggggatgtagaaagccgtaaagtccacgctactgttgaaaatgtttacatctccgctctcaacctgccttgggttcgtgttaaatggtgttaaattctgcaaatggaggggaaaaaaatcaaattctaaatttcaaagtagaatttaaagcaaatttgtaaaaaaattatcctaccaccccttttggtccacttaagatatgccacgctgaagcaaggtatttcctactggattttgctttcactggtgtttagaaaataaacttgatttctctaggagcactcctttggttagagggatgcaagaaggagaggtgaaggtggcgtgtggtggctcatgcctgtaatcccagcactttggggaggccgaggcaggcggatcacttgaggccagcagtttgagaccagcctggccaacatgatgaaaccccatctctactaaaaatacaaaaaattagctgggcatggtggcaggcacctgtaatcccagttacttgggaggctgaggcaggagaattgcttgaacccaggaggtggaggttgcagtgagctgagattgtgccactgcacttcagcctgggcgacagagtgactctgtcaaaaaggaaaggcaaaaaccggaccctggagctctgtgggccctgattgcaggcccctccctgtgtgatgagggatgagtcagcttggggagccacttggccagcctgcatgcctggtcatcaggaggttgagaaaagccttgaaagttgtgaagcactgagcagatacaagtgtttgttaattttgtagaaattaactttcccatctggcctttatctccaaagttggtattgttgctccacgcagactgcagtccggtttcttattgtgactttgacaatgcaaagtgcaaaataggaagaggcctccccaccccactatcccaccctggtgaccaattcagtgtaaccattgcacgtactcagtcattggtgtctttggagtgacatctgcagccagttagtgccacctgagtacagcactcgtacttttacatgatgtgtgtgtgagtagctcttctgtccaaaccatgatttgaggttcaactacctgtagatcaaagctttattttagaacgataaactgattttttccaaatgggtgaaatcttctccccatgactatgttttcttaactttgcattgaatctatttactgggttacattctatgtgtagtttgctttcttcatttttttttcttttaaaatgctcatgtcttattccaagcaccttcctccaaagtccccataaagctgcatctccaacacattgttatgccaataaggttttatttaactttatttaaggatgattgtgtctttgaatgacaaatgtactgctgcttcctacctgcaagacgcacaatgtatgtttcaagggtgagcaagtgttatttcttaaatttctcaaatgcctgtagtaactattgtttctgcctctcaattgttgccagctctttgaagaaggggagaattgtgtgtttttgtgtggggatgtttctgatatgctgctacagttgcaaaacactggagctagagaaaataaagtactgatctt

SEQ ID NO: 3892 - DNA, 4988 bp, Homo sapiens
agaaaaacggggagcaggagccagactaggggaggaagaggactggcccgctcagggaatagctgggttgctgcaaaaaggggcggggagaaggcgggggcgctgcatgcagcgcgctggctccagcggtggccgcggggaatgtgacatcagcggcgccgggcgcttggggctggaggaggcagctcgcctcagctgcgctgtgcacacctcgcccgggggaggacgcagacccgggcaggcggcagggatgtcggcgaaggagaggccaaagggcaaagtgatcaaggacagcgtcaccctcctgccctgcttttatttcgtcgagttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatcaaaaaaaaaaaaaaaaaaaa

SEQ ID NO: 3893 - DNA, 4909 bp, Homo sapiens
gcggccctgcccccggcacggcccccaggtgcgctccttctccggctgcttgtagcactggtctcactgtccccgccgtcagccaccggttccttatccgtctcattccccattgtggcttggctgagccggtcgccaggcctcgctgtcctcctttgccttcctctctcctcagcggccgtactttgcgccgtacctcacctggcctgcaggatgaagaaccccatgctggaggtggtgtctttactactggagaagctgctcctcatctccaacttcacgctctttagttcgggcgccgcgggcgaagacaaagggaggaacagtttttatgaaaccagctctttccaccgaggcgacgtgctggaggtgccccggacccacctgacccactatggcatctacctaggagacaaccgtgttgcccacatgatgcccgacatcctgttggccctgacagacgacatggggcgcacgcagaaggtggtctccaacaagcgtctcatcctgggcgttattgtcaaagtggccagcatccgcgtggacacagtggaggacttcgcctacggagctaacatcctggtcaatcacctggacgagtccctccagaaaaaggcactgctcaacgaggaggtggcgcggagggctgaaaagctgctgggctttaccccctacagcctgctgtggaacaactgcgagcacttcgtgacctactgcagatatggcaccccgatcagtccccagtccgacaagttttgtgagactgtgaagataattattcgtgatcagagaagtgttcttgcttcagcagtcttgggattggcgtctatagtctgtacgggcttggtatcatacactacccttcctgcaatttttattccattcttcctatggatggctggctaacttcatacccccatgtcagtgtgtgtattctgtatgtaaatatgtttatatttatagagcatcaatcaatataagcattattgagaaaaatgtgacccgtaacactgtgttctggataaaaatgtgattaggaatcacgcaaagtgcttactgtgtaagcccaagaacaaaggctttctgaatcttctcaggcagttcagatttaaagcaccatccaaaccttggaaatacgacagggtgtggtagaattcagcaatatgagaaaaccagcccctaaaatgatagccacaagagattaattgtgtttttttttctcctgtaatccttgtactgttcggctgaatttgaagattggaagacttatattgagaccagtaactttactgtaaatttactttgtttcattgaaaaaacaaattgataaacatattaaactggaagaattttctttattcaaatgaaaacatgtttgatgactggtcaaaaaataagctcataatctatttttttcatgtagtatataagtcaagaatgttttattgtcattatgtgaaaccaatattggcaaatagtactttaatgatgaagtaaatgaccagaaattatagaaatctgtgttttcctgtaaaaatagcactatagtatcacttgaacaatttgatttggctttacttactaggaagcctggaattcattatttttttccttttatgtgccactgtggctactttaaatcactctgagaggtaaatggatataggattgaagttatgtgggtatttggcatgtgtgtgtgaaataaatatgtagatagtcacatatacacagactgagagataaattgttcttgattgctttattatcatcatactagtgtgttcattatagagtatctgtagaggtgaatgtaaaagtaagtccaatctattttcttatgtcattgaatttgtagtgttaacttgcatatatgttattggatgggttgtcttttaaagcatttactaatgtactctgaaatttttaaaagccttcagatttgttttctagtcacttttttccatatcatttctaattatagtttatatccttaaaagaaggatgccacagtagtatgtaaaacccaaacaagtagaacccaagcaaataaaattatttaaaataattttaaagtggcttagtactgccagtcatgtaaattgattctgctgagggtcttataagaattgagatataacaatggtaaaacaagcattcaagcacttttacaaaattaccaaattcttaaaatgaagccacagctagacttgcatttcaggtattaaaattgctttcttaactgtcaagaatcacaaaataacaaatcatattatgagtgaatatggggagggcggggccaatcagtcaatgataatctgaacaaattttaagagcagattttagattaataatgttttatcaccactaatttgcccacaacaaactcagtatttaatttttcaaattaaatattaaattatttaagtattttaaataattaaaacattaaatggcaacaccatagaatataggtgttctctggacctattctaaccacttaaaattatcttaagtatgcatacataaaagcaaccactatgagaactaccgtgttagtggtttttcacttactgtatattacccttgtaggaatagtttaaggaaattcatttcttaaaaatatagtgtcctcaaataattaatttttttgcaaactttagttattacaggcagcaaaaaccactgtctgaaactaaatctgtgttcaaagatgaagacccctcattaaaagccaaggacgttcttaagattggaactgacataattagtcttgacttacttcattaaagcaagattcaattccttgttcatttgagtgttcattatatgccaggcattgaccagttgcaattttatggtccagaattaatattattattcgtaaactagctataatagagtatatacagtgctgtgggaatacaggggaagaagcaattaaatctgctagaagggtaagagaaatctgtatgcaggaggcaatgctagcattaagccaagaaatagtgtgaggtgatcttatcacactgatgtgttcaactgtttatgggaaaaggaaactaggatggttttatttgtgaaatgttctacaacgctagaactgttgaacttcttgggagaaaaggagaatctttgttttgttgtgctgagtttgattagttgcttaaccaagtagaaagaaaagcacatcttcctgatcacagttataaaagaaaccctgaggccgggcgcggtggctcaagcctgtaaccccagcactttgggaggccaaggagggaggatcacaaggtcaggagatcgagaccatcctggctaacacggtgaaaccccatctctactaaaaatacaaaattagctgggcgtggtggccggcgcctgtagtcccagctactcatgaggttgaggcaggagaatggcgtgaaccgaggaggcggagcttgcagtgagtggaaattgcgccactgcactccagcctgggcaacaaagtgagactccatctcaaaaaaaaaaaaaaaaaaaaaaaaaaaaaaagaagaagaaaccctgagccattaatgtgtctcgtaacttgaggaagttcatgaattctctgggcttcatccattaagattcatccttatgctcctgcaagtttcttatatttatgtatttctattctgatttctgaaatgataacctagtagtgtctgatgaagttttttcatgcttattttattctttgtcacagatgaaagaagaataggactaattggggctaagatgaattaatgtaagtgtcagatactaggcaggtgttagggatgaaatgatgaatgaggcatggacctgttcctcagagtttatggcccagtagacataattgtattaggactttctgcagttgacatttgcataaagctgactgactgaaggaacagaaagtgagacagacagatatgaccaaatttatacaaaccatgtaccaacacttgaaagatgggtggatattttccaggaaacagattttgggcaggacattccatgcactggaaatagcatgaacaaatgcatgaaaattgcctacaacatgcctggcacatagctgtgaggtaccctatgagttgttgacttgaaaacatggaactgcacagggcattcaggcaagtgcaagtggttcaggggccagcgcagagcagagtgctgagtaaagatgtcagaaaaggaaagcaatggtctggtacaagtcttgtatagaacaagaagtttagacttttgaacaggcaatcgagatttggggttcagaaagataaatcccaaaagtatggagaacaaaggaactcattttaaaggactagctaagatgctcaatctctaaaaaaaaaaggatctgtattcgtgagagtagagagaaaggttgtttaggaagagtcaacagactttagcaaaatccttttatttgattcatgcataactcctgatggagtgtcaaggaagactcattcacttttctttcctgccagaaagttggttcttgcaaaatagattaacttgatgactatgtgtatattggatactcctaattttagctctgttagatatgtttctttctaaggacaagcaactatgtatagacttgttgtttgaattttttttcagtatatatatgtttcttgtttttctatttttctacttcatactgttaatgtcaaatatcaaaaatgttttccagcaatatcaagttatggcaatggcaaaagtccttgttgtagatgagaagcatataagaaatggttgccaatctttgttttgtatgatctatttagagttttaaccaacctagatctgtcagctaagctaattttatatttggtatacatgcatgtcaaataaagttaattttacatacaaaaaaaaaaaaaaaaaaaaa

SEQ ID NO: 3894 - DNA, 3389 bp, Homo sapiens
gtcggtgtgacaactgatcgggtgaacgatgcaccactaaccaccatggaaacaaggaaaaataaagcaagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaagcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttgtttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactagcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcatgccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaacaaaaaaaaaaaaagcgaaagactgcagttgtgctaaaaacaaaacaaaacaaacaaacaaacaaaaaagtaaaaaaagattactttcgagagagaagtttaagcttcaccaatgctgctcctgaccaatggaaatatgtacaacttcagcattttaagtaactggcttcaaggggtactgtggcaaccaaataaaataactccattttctaaaactttcatgtaacttttatgtctggactacagttcaagtggacaaaaacatttctgtattttttttaagtaaataagagtagttgaactgagcaatacctcctcctgtgttgtattacacatattagccacgagtttttgcagtgaccagataaacttgaattgacacgtggtgtaataaaatggacaaattctgtagagtagacacagtgagtatgtggacctcttttataaggaaaaatacattttggattaaaatcaaaaaaaaaaaaaaaaaaaaa

SEQ ID NO: 3895 - DNA, 17821 bp, Homo sapiens
cacgctcccctcgactgcgctccagcctggggcgcgcccggccgccgccgccttcgctgccgccacgggcccgtcttcttcctccttcggctcccaggatgaagaaactgagtctcagagaggtgaagtgacttgcccaagatcacagcaattatcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctgatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatgcattccgcaaatcaaaatatcttgatggataaattatagagctt

SEQ ID NO: 3896 - DNA, 19271 bp, Homo sapiens
ggctctgattcagttttctttttcttctcttttccttttttttttttttttttttttttttttaggaatgcagagcagttgctggggtgattgacctaggcacagtggagatatttcccatcttcaaagccatgcaaaagggcctccttgaccaagacacaggcctagtgcttctggaatctcaggttatcatgtctggcctcattgcccctgagacgggtgaaaacctctctttggaggagggcatagccagaaacctcattaatccccagatgtaccagcagctccgggagctacaggatgccctggccttaataagcaggcttactgagagcagaggccctctttctgtggtggaagcaattgaaaagagaataatcagtgagacagttggactgaaaatcttagaagctcacctggcaactggaggtttcagtctttcccctagtgagaactgtattaacctggaagaggcttttcatcaaggcctcatttctgcatggcttcattcagtattagagtcttatcttagaacatccaagaatttgatagaccctaacacagctgagaaaattggtttgctggatctgatgcagcgatgtattgtccaccaggaatcaggattcaaattactgcctgtcaaacaattggcaggggggatggtgagcttgaaatcaggccggaaggttagcattttccgtgcagttcaggaagggctaatagataggcaggtcactgtccggttgctggaagctcagctttttgctggtggcatagtagatccaagaacaggacacagacttacagtggaagaggctgtaagacataatctgattgaccaagatatggcctgtgctatcctcataaggcagcttcagacaggaggcatcatagacactgtcacggggcaaaggctaacaatagatgaagcagtgagcaatgatctagtagctgctaagatcgcccttgtgattctggagtccctctggtcattcatggggttgctgtggcctgaatctggagagatcctcccaattacagatgccctagaacaaggtattgtgtctactgaactagcacataaaatccttagtaaccgacagcatattaaggctctgtttctaccagcaaccacagagattttgtcctggaagaaagcaatagaaagtggtatcctggatagagatcttgccaataacttaaaatcgatttgtatacctgatgtgatgccccacatgcaactagcagactctgcagaacaaaatattaatcctggagcagcagttctaccgtgcagcaagagccaccctaaggccacagcaagccagagtgagaatctgttgttccagctgatgactcacagctatattaatgtgcaaaatggacagaggctgcttctgttagataaagagctgatggagacactaacatccagagatgagtatcaaacaagtcctccaaaagtggttgaaattgggcatcaaaggcaaaaaactcctgagggattgcaagaatcagctaatgtgaaaatctcaggaactttcagcagtgggtggactgtgaggctgcctgagttccagttttcttctcagaacaaagaatatcccgatcgggaagattgcactacagaaaaaggcaaaaagaccactgtagaaacagaagattcttctgtagagaaccctgaacaggatctgtttgtagaacaaaaagagagaaatccaaacattgatgctttgaaggtaataaataaagtcaaattagaggtacaaaggcagttgataggtacccaaagggaagaccaaacagcagtgtctgtcagagaaaatgccagcaggggacacctcctgaccatacctcctgctgaggcggaaggtgtgccgttggtggttgacaaagatgttttttctgttgaaacaccaaagaaagaacatcaacctctaagaaacacttcctttacatgtcagaatgaacaagcacacactcttgagactgaatatattcatgatgaaactggaggatctcacataaaaccccaaagcaaaaagttacaagttcaggtaaagaaaactctaggtataaagttagaactaaagtctgaaactgatgggaatgttcatcctctggacaaaaaggaaatgttaaagaaaacatttctggctaaggatgaccataaagaaagtcaagaagcacagaacatcgcaggtggtagtatgatgatgtcagaaaagaccgatgaggaagatagtggcagggaaatttttctgtcatgcagtcatccattagaattgcttgaagaagctaccttaaatgtattatctgcacagttactagatggtggtatctttcatgaacaaacaggtcaaaagctcttactaaatgaagcaatatcccgaggcattgtgccaagtcacactgccgtgaagcttatggagaagctgaacatgtttcaggggttctttgactctcagacttgtgagtctttgacaactgaagaagtcattaatgaaggtctgatggatgagaaattattacataatgtcctcatggcagacaaagctataagtggtgtcttagacccccgtacccagacactgtgctctgtaaaggatgcagttacagttggacttcttgacaaggaaacagccaccagaattttagagaggcaggtggtgactggtggaattattgatctgaaacgaggcaaaaaagtttcagtaactttggcctcaactcttggcttggtggacgttgctgaccagccagaacttataaatctggagaaagcttccaaaggtagagatgctgaaaaaacagttagggagagattaattagtttacaaatggaaacaacaggacttatagaccctgatagtaaagcacctttaacagttgtgcagtccattgacagaggtcttttggagagagaggaggccgttcgtttgttgactaagcaagtggtagatggaggtatcattcaccatatatctgggatgagactttctgttgataatgccttcagacatggcttaattggtgaagatttagccgagaaactcaaaagagttgagaacttaaacatccatcagatttttaatcctgaaacgaaggaaaatatttccctccctaaagccataaaattagatcttattacctcagacctgaaaagagaaatccaggaggttcaggcctttactggaaactttgtggatctcatttctggtcagagattgaccttggcagaagctaaaaaagaaggactgttaactaatgaagcagtattgtctccaggaatgatgcatggcattgtagatcccgagaactgcagaattgtcccctactcagaattagtcaagaaatgtaagattgatattgaatctggacagagatatctagaagtaattcccttctcagacattaaagatggggtgagcgacaaagtgcttacattgtctcaagcaattcagcttggaaaagtagactttgcatctacgctgaaggttctagaagcccaggcaaatactggtggaatcatagatactgctactggaaaaagactgacattggcatcagctttggaagagaaactggtggatgaaaacatggtcagaattattgcatctcatcaggtgttaaatggaggaattgttgacatatttagtgatcagagagtgactttagtagaagctattgagaaaagactgatcagccctgaactggcaaatatgatccaaatagatagttcagagttcagcgatcacagggctcagattgaaaagcaagaagggattgaagtgtgtgcattacaaaatgaatttctaggaaaggatatgttaattgcttgtaatcagactgctgaaatgagttgtaataaagtagaagagagtgagagattatttcaagttgaaaatcagtctgcacaagaaaaggttaaagtgagagtttctgatggggagcaggcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctgaagaaataagagaaaatcaaggggaagtgattttggaagtacaagaaacatattgtgaaacgtcaggcaaattgccgagtgagcaggttttgcagcaaccaatgaatgctcgggtgaaaagtaagagagagaagagggaggtgattgtagaagaaagtatcagaacatgcaaaccagcatttctttctgaagaaaagttgtatcaggaaactgccattagagatgagcatgactcccatataaagagccaacctagggaaatgacctcaagtgaaaaagggaaagaagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttccagagaaactgttcaaaggagtgtctcaaaaagagaatacagggcaacagaatgccatcattagtcctactgttctagagaccagtgaagaaaagacagtgtccctaacagtatgctctgcagtgaagacagagaagacaccacaggaaaagctcagagaaagccctggcagtgaacaaactcccttcatgactgcacctgaaggaaagggaaatggaggtgtaaacccagagcccttcagagcaactcagaatgtatttacccggcaactctgtttagaacatgatgaaaagctagtatcctatctgtctctgttacggaacattgaaatgaggaccaaacagattcaacctttggagctaaacctggcagaactacaggatctgctgtgtcaggccaaggtattagaaagggagttaaaggatctgaccaccttggtcagtcaggagctggagtgtgtgaatcagattatcatcagccagcctcaagaagttcctgctcaactgttgaaggctctagagaaagatgccaagaatcttcagaagtctctcagctctgtgagtgacacttggaattccaggctactccacttccagaatgctgtggaaatagaaaagactaaagtgttaaatcagcacacacagctagaaggccgacttcaagatctgagagcctgggttggcaataaaaatcttattctgaacagcaagggatctaacagtgaaatagatgttgacagcctgaacctctgcctccaacagtatgaggatttgaaacagcccatggctgaaaggaaagctcagctggatgctcttgcttttgatattcagttctttatctcagaacatgcccaggacttgtcccctcagcagaatcgacagatgctgaggcttctgaatgaactgcagaggtccttccaggacattttggaacagactgccgctcaggtggatgccttgcagggccatcttcaacaaatggagcaggaagccctggtgaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatgcattccgcaaatcaaaatatcttgatggataaattatagagctt

SEQ ID NO: 3897 - DNA, 6880 bp, Homo sapiens
agccttgagtgtcattcaagggacagcacaacctcatccaagctctcctacctctgcccagccgtccctctcatcctccccattcctcgtccacactccatccaaagaagagggaaagcaccgaatagaggggggcgaaggcaaagtctgctgttcttccccctgggcccccttgctcctccatcctcattctctcaccaccagcccccctaaccccaaggagcccaggaactgaggcgactcgccccactgccatgtccaaaagcttgaaaaagaaaagccactggactagcaaagtccatgagagtgtcattggcaggaacccggagggccagctgggctttgaactgaaggggggcgccgagaatggacagttcccctacctgggggaggtgaagcccggcaaggtggcctatgagagcggcagcaaattggtgtcggaggagctgctgctggaggtgaacgagacccccgtggcggggctcaccatcagggacgtgctggccgtgatcaaacactgcaaggaccccctccggctcaagtgtgtcaagcaaggaggaattgttgataaagaccttcgtcactacctcaacttacgatttcaaaagggttctgtggaccatgagcttcagcaaatcattcgtgacaacctctacctccgcacggtgccatgcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcggaagtgaaagcaaggcaagatgtgaaaccagacatccgacagcctccattcacagactacaggcagcccccgctggattacaggcaacccccaggaggggactaccagcagcccccacccttggactacaggcagcctcccctactggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacgggaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggcccgggggctgcgccggcgtttgccggcccgggcggcggcggcagcggcgcgctggaggccgagggcagggcgggtgcgcgcgcgggtccccggccgggcccgcgacccccggggggcgccccggcgcgcaaggccgccgtcgcgccggggccctggaaggtgccgggttctgacaagctgcccagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacattcggaaccgttcacccatgacatgtttccatggctcacccttggcatccatcctcggtgttagcagcagcgttccctgcctcctgcaggatgacttagaaatctagtgagtttcttggtgtgatgccatttttattgccctttctgtgatcaaatcatatttctgtacattttcagtggtagaaaaaaaaggttttaaaaattgtatcctagggaacagtttgccataagtcagaattttgcagtttagctcatagatcttaattggtttttctctaaaatatgaattttataattgaaggaccacaatttgtttaatcaagataggcaacgctgcagttcctttatgaagaggcttttctgtcgtcccaggctagcagagatggatagcttctttgtcagcaatgtgatttcacttattttattgtcttattttaaaccctgtctccatgacttcatttgcactttgacagagcagaggcagagtatttgtcttatatttctcagattataatattaaaaaattacaatcaatttattttcattaaagaacgtgagtctttttagcattcctttctgcttatccttctttccttaccctttgtccttttgtttccattagttttctttcgtcttgtattccttgccactttattttgttagcaacttctagatgtttatcttcatggatctatgattgacctcctagtaaaattctaagtcttgcctttcttccctgctgttttagcatttctttgtaaaatgttagcttcaattaattagccattggtacttactgtagctacacatattaaaaggcaaagtgtttctgaaggcaatttctttttaatatgcccgaatgaatgaggcttcatcctttccatattcttactctttacaggagttcaaatgcaaataagctccacctccctgcacttgtagtctaaaaagtaaaaggggcgatcaggtccatctcaaaggtcacacgtaatagcctccctgggctgatcattccctctccttgtaattgcagtatcctgagtagcagtttaattttcatcaaacatcggagtagtttagttgtttgacaggaggagaataaggctgaaagcctcaagtgaaggatcttgcagcttgtaaaagcaatttccaaaaatgaaacccattcatcgtaaacaaaagcacaaacacttgtagcagtttataatgcttttggtttaatctcaattagtctttctcccctggactagaaatccagtatagtttgccattaatttattgaatctggttttggacaatgcttctgtagtgtagctgcacgtcctggtactgtatcctctgactttattttccatgtattacaaaaggaaaaaaaaattgagattacactggcataaactctagtttgcacagttcacagctactacttgtgcagtaattgctttatgcggctgtaatccataacctgtgaagacagcacatcatctaaatcccattccaaataatatttgtgtagtgttagctgtgaatttaccctgtacagctgtatctctataaatataattccatgtattaatagtcacagaaagactgtaagtgagcaactatttttatgaaacgtaccactatggataaattaacttttacagaaatcttgtttactgtatgatattctaaaacactgtcaaataaaatatatatccaaaaatcttttctttttccaacta

SEQ ID NO: 3898 - DNA, 2808 bp, Homo sapiens
ggcggcggcggcaggagcccgggaggcggaggcgggaggcggcggcggcgcgcggagacgcagcagcggcagcggcagcatgtcggccggcggagcgtcagtcccgccgcccccgaaccccgccgtgtccttcccgccgccccgggtcaccctgcccgccggccccgacatcctgcggacctactcgggcgccttcgtctgcctggagattctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcataaaaaattagtatcccttttgtttggttgctgagtcacctgaaccttaattttaattggtaattacagcccctaaaaaaaacacatttcaaataggcttcccactaaactctatattttagtgtaaaccaggaattggcacactttttttagaatgggccagatggtaaatatttatgcttcacggtccatacagtctctgtcacaactattcagttctgctagtatagcgtgaaagcagctatacacaatacagaaatgaatgagtgtggttatgttctaataaaacttatttataaaaacaaggggaggctgggtttagcctgtgggccatagtttgtcaaccactggtgtaaaaccttagttatatatgatctgcattttcttgaactgatcattgaaaacttataaacctaacagaaaagccacataatatttagtgtcattatgcaataatcacattgcctttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttgataaaaaaaaaaaaaaa

SEQ ID NO: 3899 - DNA, 10259 bp, Homo sapiens
gctgccggctgaggccggagctgccgcctccatgagaggcttcctcctacaccccagggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgagtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgcagatagtgtaaaaaaaaaaaaaaaaa

SEQ ID NO: 3900 - DNA, 3568 bp, Homo sapiens
aatttacatccattcatgaatctgtgacgtcagcaagcctttgggctcctttgcggtgggctggaggattgtgtgggtggaatccccctcccctttatttttccaattctgcaaggcttttaaaattcaccttacatcttttcaaagcaagaaaatggaacagcatgtgtaggaattcttcgttgttgttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcaggtcaggcagtggcagtggtgggtttcttgaaggactatttggatgcttaaggcctgtatggaatatcattgggaaggcatattccactgattacaaattgcagcagcaagatacttgggaagtgccatttgaggagatctcagagctgcagtggctgggtagtggagcccaaggagcggtcttcttgggcaagttccgggcggaagaggtggccatcaagaaagtgagagaacagaatgagacggatatcaagcatttgaggaagttgaagcaccctaacatcatcgcattcaagggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaatgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggcagagtaaacctcgaaaccgaccttcttttcggcagacactcatgcatttagacattgcctctgcagatgtacttgccaccccacaagaaacttacttcaagtctcaggctgaatggagagaagaagtgaaaaaacattttgagaagatcaaaagtgaaggaacttgtatacaccggttagatgaagaactgattcgaaggcgcagagaagagctcaggcatgcgctggatattcgtgaacactatgagcggaagcttgagcgggcgaataatttatacatggaattgagtgccatcatgctgcagctagaaatgcgggagaaggagctcattaagcgtgagcaagcagtggaaaagaagtatcctgggacctacaaacgacaccctgttcgtcctatcatccatcccaatgccatggagaaactcatgaaaaggaaaggagtgcctcacaaatctgggatgcagaccaaacggccagacttgttgagatcagaagggatccccaccacagaagtggctcccactgcatcccctttgtccggaagtcccaaaatgtccacttctagcagcaagagccgatatcgaagcaaaccacgccaccgccgagggaatagcagaggcagccatagtgactttgccgcaatcttgaaaaaccagccagcccaggaaaattcaccccatcccacttacctgcaccaagctcaatcccaatacccttctcttcatcaccataattctctgcagcagcaataccagcagccccctcctgccatgtcccagagtcaccatcccagactcaatatgcacggacaggacatagcaacctgcgccaacaacctgaggtatttcggcccagcagcagccctgcggagcccactcagcaaccatgctcagagacagctgcccggctcgagccctgacctcatctccacagccatggctgcagactgctggagaagttctgagcctgacaagggccaagctggtccctggggctgttgccaggctgacgcttatgacccctgccttcagtgcaggccagaacagtatgggtccttagacataccctctgctgagccagtggggaggagccctgacctttccaagtcaccagcacataatcctctcttggaaaacgcccagagttctgagaaaacggaagaaaatgaattcagcggctgtaggtctgagtcatccctcggcacctctcatctcggcacccctccagcgctacctcgaaaaacaaggcctctgcagaagagtggagatgactcctcagaagaggaagaaggggaagtagatagtgaagttgaatttccacgaagacagaggccccatcgctgtatcagcagctgccagtcatattcaacctttagctctgagaatttctctgtgtctgatggagaagagggaaataccagtgaccactcaaacagtcctgatgagttagctgataaacttgaagaccgcttggcagagaagctagacgacctgctgtcccagacgccagagattcccattgacatatcctcacactcggatgggctctctgacaaggagtgtgccgtgcgccgtgtgaagactcagatgtctctgggcaagctgtgtgtggaggaacgtggctatgagaaccccatgcagtttgaagaatcggactgtgactcttcagatggggagtgttctgatgccacagttaggaccaataaacactacagctctgctacctggtaatgaaggaatacacatcctgaagatctcgtgactatactggcatttcagatccaccccacccccagactcatcccactctctcccagcattttgtctgggaagagagactaccccatctttaccaccccctagaaatgagctgcaataacaggaacatgagacttcgcaaatctctggaaaataatatccaaatgaaattaagtctcactgaacatttcaatcaagaatggcagggatctattttattgaatattctagctactgtaacattgatatttatttttgtttgacattttaacactttgtactgcaaagagtgaactatatatgagatagagagacaataatttcttgcaaaaaaaaaaagagataaaagaaagaacaaaaaaaaaaaa

SEQ ID NO: 3901 - DNA, 1866 bp, Homo sapiens
cgttcctcggcgccgccggggccccagagggcagcggcagcaacagcagcagcagcagcagcgggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcagcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggagctcaggtggccccagttcaatctcccgctgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctgaaaaaaaaaaaaaaaa

SEQ ID NO: 3902 - DNA, 3079 bp, Homo sapiens
agtcccgcgggccgtgcgcggtgctgtgccgcgccctgccagacacaggtgcgcccgcctagcccgaactccgcggcggcggctgccctctcgccgcgcctccgcctccttcgcagccgccgcctcctccgcgccgcgctccgcccggatggccagggctgtgcccgagaatggcggagcgagaaagcggcggcctgggagggggggccgcgtccccgcccgccgcctccccgttcctggggctgcacatcgcttcgcctcccaatttcaggctcacccatgacatcagcctggaggagtttgaggatgaagacctctcggagatcactgatgagtgtggcatcagcttacagtgcaaagacaccctgtccttacggcccccgcgcgccgggctgctctctgcgggcggcggcggcgcggggagccggttgcaggccgagatgctgcagatggacctgatcgacgcgacgggggacactcccggggccgaggacgacgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgccgcggtctcaggacacactgaataataattctctgggcaaaaagcacagttggcaggatcgggtgtctcgatcatcctcacccctgaagacaggggagcagacaccaccgcatgaacacatctgcctgagcgatgagctgcccccccagagcggccccgcccccaccacagatcgaggcacctccaccgacagcccttgccgccgcagcacagccacccagatggcacctccgggtggtccccctgctgccccgcctgggggtcggggccactcgcatcgagaccgaatccactaccaggccgatgtgcgactagaggccactgaggagatctacctgaccccagtgcagaggcccccagacgctgcagagcccacctccgccttcctgccgcccactgagagccggatgtcagtcagctccgatccagaccctgccgcctacccctccacggcagggcggccgcacccctccatcagtgaagaggaagagggcttcgactgcctgtcgtccccagagcgggctgagcccccaggcggagggtggcgggggagcctgggggagccgccgccacctccacgggcctctctgagctcggacaccagcgccctgtcctatgactctgtcaagtacacgctggtggtagatgagcatgcacagctggagctggtgagcctgcggccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggactccacgcctgatgaacccgacgtccatttctccaagaaattcctgaacgtcttcatgagtggccgctcccgctcctccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcctgtctggaaaaaaaaaaaaaaaaaaaaaaaaaaaaaa

SEQ ID NO: 3903 - DNA, 4638 bp, Homo sapiens
ggcgcggcggcggcggtggctgtgaccgcgcggaccgagccgagacattcgcgccgggggatcgggcgccgccgccgctgggccccgggcgcgtggatgcggctgggtcgggcggcgccgtacacctgaggcggagaacggggcgcggcgcgggtgacgctgtcagggccgcggttcctgacgcccaggcgctcgccaggacgagccaggcagtgatttgaggcaccggcttcaccttcacccatggtccggagagcctagcggggctcgccaccgcctcccggctccccttccacgcctcatcctgccagcctcgccgccccgccagcgccgggcaaccgcctcgcccgaagccctccctcgttactgtccgcataccccggcggcgccgccgcgggaagcggctccccctcctcttcctccgcgtcctcttccctctttcccccgccggggccgcttgttgcaccgccccgcggcctgcgggagccgctcgccccggccttgtgctcgcgtccgcacccctttcctgtcgccccccggggcccgcaccacagcccggccggcgagaccccggccagaccccgctgcccgcacaaaatgtcggcccggacgccattgccgacggtgaacgagcgggacacggaaaatcatacatctgtggatggatatactgaaccacacatccagcctaccaagtcgagtagcagacagaacatcccccggtgtagaaactccattacgtcagcaacagatgaacagcctcacattggaaattaccgtttacaaaaaacaatagggaagggaaattttgccaaagtcaaattggcaagacacgttctaactggtagagaggttgctgtgaaaataatagacaaaactcagctaaatcctaccagtctacaaaagttatttcgagaagtacgaataatgaagatactgaatcatcctaatataggtgaagtatttgattacttagttgcccatggaagaatgaaagagaaagaggcccgtgcaaaatttaggcagattgtatctgctgtacagtattgtcatcaaaagtacattgttcaccgtgatcttaaggctgaaaaccttctccttgatggtgatatgaatattaaaattgctgactttggttttagtaatgaatttacagttgggaacaaattggacacattttgtggaagcccaccctatgctgctcccgagcttttccaaggaaagaagtatgatgggcctgaagtggatgtgtggagtctgggcgtcattctctatacattagtcagtggctccttgcctttcgatggccagaatttaaaggaactgcgagagcgagttttacgagggaagtaccgtattcccttctatatgtccacagactgtgaaaatcttctgaagaaattattagtcctgaatccaataaagagaggcagcttggaacaaataatgaaagatcgatggatgaatgttggtcatgaagaggaagaactaaagccatatactgagcctgatccggatttcaatgacacaaaaagaatagacattatggtcaccatgggctttgcacgagatgaaataaatgatgccttaataaatcagaagtatgatgaagttatggctacttatattcttctaggtagaaaaccacctgaatttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatgctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtaacaatgtgtattctggaggtagcatggcaagaaggaatacatatgtctgtgaaaggaccacagatcgatacgtagcattgcagaatggaaaagacagcagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctggtacaacccagagagtgcctgctgcttccccatctgctcacagtattagtactgcgactccagaccggacccgttttccccgagggagctcaagccgaagcactttccatggtgaacagctccgggagcgacgcagcgttgcttataatgggccacctgcttcaccatcccatgaaacgggtgcatttgcacatgccagaaggggaacgtcaactggtataataagcaaaatcacatccaaatttgttcgcagaagtacatcaggggaaccaaaagaaagagacaaggaagagggtaaagattctaagccgcgttctttgcggttcacatggagtatgaagaccactagttcaatggaccctaatgacatgatgagagaaatccgaaaagtgttagatgcaaataactgtgattatgagcaaaaagagagatttttgcttttctgtgtccatggagacgctagacaggatagcctcgtgcagtgggagatggaagtctgcaagttgccacgactgtcacttaatggggttcgcttcaagcgaatatctgggacatctattgcctttaagaacattgcatcaaaaatagcaaatgagcttatgctgtaaagaagtccaaatttacaggttcagggaagatacatacatatatgaggtacagtttttgaatgtactggtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaaaaacttgtatagttgtctagatttctgcacctgaatgtatgtttgatgctttgatttgaaaatgttcttccctgttatttacattctggtgggtttttaaaattcttacctccatcatgcaattttgaaaattgtgtccagaattaaaagtgcatagaaatagcctttacaattgtagcatggacctttaaaaattgttttaaaatcttatttaaatttaaaccagaagctgaaaaatagatcagctttattatacacaaaattattactgcttatctttgctcttttccttgttatcccgcaaggtttagttgagaagatacaaaatgtttacagtgttggcacttagagtttttaaattcaagtacatgaaattcagtaatagcattgccttgagctaactaggaagtaccgggaaaaaagttaaatctacatcaagtttcttttgaactttgaagtgttttctgacccactgctaactgtagcaacaaaatttaaaagaaaaaaaacatactttatctggctattataacataaactgtcacgtaggtttgctgccttcagaataccgcaatttaattgcgggaatataataatattgggactgtttcacagcacaaactcatctttacagtgttgatcaatgcatcagttaagaaataatgccacctcaggaattaactggcattgggaacatttgcctcattctcctgctatcctcttcattcacccctgccactgtaatatctataagtacttaagagacttgtgagcaaaacatactatttataacagtatatgattgatttatgcttatgtggttgttcagtttgttcccatgtaactcgtttgttttaaatattttgccagatttcttgtatttattccacatcattatgcctataatgtgccgctttgtgattgggcatttgcctacttttctttcataattagtgatatatgcgatgtaaaaccactagtaaaggtacattttaatacttgttattttatactgaattagccttggaggttgactgtgcaatgttatttactgttgtaattactgtaataccaacatatgggccccatctgcacactcctgaaaaacagaaagtgtattcaaattttatcagtttaaagaaaataaagctgtgataaatactgtaattccaacctacattagaaggtctaagtgtaggtgatgtgccattccataatggcttccagactagggtgaattttatgttctgtactgtactgtgatgtagctttcttctgtaacagttatgttttaaaattaagtgagttttttttttgccttagcaaagggtggtgtttgaaaaaaaaaatgtgtagcccctttttaacctagtgttcattcaaaaaaaaattgatgcaaatctttattcactttcactggtgcacactgaaattttacttgaacagttctcataataaagcacttgtcttttgctcttt

SEQ ID NO: 3904 - DNA, 1909 bp, Homo sapiens
aggttacaagcagcagatcccaccttcagtcctggctctgacaagccctccagcttcacgccacccgggatgggagaaagcaggtgtcgcgagagttgggcgcaagacgccttgtagggagtgtaactatggccggcctgcggaacgaaagtgaacaggagccgctcttaggcgacacacctggaagcagagaatgggacattttagagactgaagagcattataagagccgatggagatctattaggattttatatcttactatgtttctcagcagtgtagggttttctgtagtgatgatgtccatatggccatatctccaaaagattgatccgacagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcaggaaatgtagcagttgttagatcatatactgctggtgctacttcccttcaggaaagaacaagttccatggcaaacataagcatgtgtcaagcattaggttttattctaggtccagtttttcagacttgttttacattccttggagaaaaaggtgtgacatgggatgtgattaaactgcagataaacatgtatacaacaccagttttacttagcgccttcctgggaattttaaatattattctgatccttgccatactaagagaacatcgtgtggatgactcaggaagacagtgtaaaagtattaattttgaagaagcaagtacagatgaagctcaggttccccaaggaaatattgaccaggttgctgttgtggccatcaatgttctgttttttgtgactctatttatctttgccctttttgaaaccatcattactccattaacaatggatatgtatgcctggactcaagaacaagctgtgttatataatggcataatacttgctgctcttggggttgaagccgttgttattttcttaggagttaagttgctttccaaaaagattggcgagcgtgctattctactgggaggactcatcgttgtatgggttggcttctttatcttgttaccttggggaaatcaatttcccaaaatacagtgggaagatttgcacaataattcaatccctaataccacatttggggaaattattattggtctttggaagtctccaatggaagatgacaatgaaagaccaactggttgctcgattgaacaagcctggtgcctctacaccccggtgattcatctggcccagttccttacatcagctgtgctaataggattaggctatccagtctgcaatcttatgtcctatactctatattcaaaaattctaggaccaaaacctcagggtgtatacatgggctggttaacagcatctggaagtggagcccggattcttgggcctatgttcatcagccaagtgtatgctcactggggaccacgatgggcattcagcctggtgtgtggaataatagtgctcaccatcaccctcctgggagtggtttacaaaagactcattgctctttctgtaagatatgggaggattcaggaataaactagctaagactgtgatggaaactacttgctgtgtggcacttcctggtctaaagctctgctagacaattgcggtgagccagtctccaagaatcagactacagatattgcagattttgaagaacaagaacatatgttgaataacagagagaattctacatgtcattgtgaatagtaggttatataaaaacatactagatgataatttcaaaaaaaaaaaaaaaa

SEQ ID NO: 3905 - DNA, 2180 bp, Homo sapiens
ggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacgaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccaggaaaaaaaaaaaaaaaaaaaaaaa

SEQ ID NO: 3906 - DNA, 3479 bp, Homo sapiens
agcggagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctggcatgctacaagtgaaaactgatgagaaactgaatgtgtctgatgagaatacagcaagttgccctttgagccccattaagatgtgccttaatcgtcccattgaatggaatctgaatttgacaacagcatctctaacgagctgtacagttcataaccaaaatctcaaaagcgaagagaaatagattgcagttcttcttgcactatctttattttgtatgtcagtattccttctgaacaataagcatttatcaattgatcttgaagtatttctagtcctgtgatttgtctttatattaaatcattagcattaatcattttgattatattctttatatgtttttttacatgttttacatcagatcattgtggaattttgtaaacggattttgatgtttctcttttagtggtattatgtgaattttttatgccctaagtttaaatacgtaattgtccctagttttatttctgtgcacaaagttttaatatataacacattgtgatttataaagctagtattgtaaagatttgtgatgataacctgacccatgagcagttgtaaaacaggtggataccaactacctcgaagcaaattggtgaaagaaaaggcaaaggtatctcttagaagtaaatctccttcaacgttatatatgtacagaagaaaaaaagttgatcatagctttttgtcaagtagcatgtttcccattcacaggaaaatgtgagcttatcagttctttctctgtattttaaatctaagtctgtgggctttaagagcaatggcacaattgcatgtttactgttcagcaaatctgtgcctcttgatagagaaaaatactatgtggtttctgtaagttaccagttttgaatgaaaaatggtaaatggatttacatctgttttattgtaccttagccttttattttaaagttaaagggatgacttttaaaagcaggacattccctacctttaatagtgcaaagcacagtttcagcaatggctacatgactatgtctaaaaactgaatactcagaatactaaaggtttggtgcttaaatttatttttcccatgccagagaaagcaagctttggtatggtaaaccacatgagaacatggctcctttctttttggatagcctggccatgtgtgaatgggattttagcttattatgtttctaagacttttccttacagcacacttaatgtaccttttcagtccttctcccaaccccctgcaaattgtctttaaaacaacaacacataaggaatctgaagcacaggagaacacagagccaacaaacagaatgaagaacaatcatctatttttaactgactttctatcattaccatttttccttttgcttaataactatcttgctttgaaactttgactccttttataagttctatgaggcacatatgtatagcaatttggttctaaaaaccagtgatcttactttagctccatcttaaaatttcaccttaagtaaatggcctctagtagatgataagcctaaaaaaagcacaattattaaaacaaacagatccatgttaggacatttctgaataataaagagaaaaggtgtttcgttgggtattgcagaaaagaggaccaatttcatatagtacaagtttcgtaagtcaggccaagtgtcaatttcaaaagacaagaaatgaaattgacagtgaatagtgctcataaattggtagcgtatataaagagaagttcctgtcacattatattcccactagaattattatccacagtaaataaatattattttgttatgccaaaaatatagcgagcagcttcatggttaataatacatttatgttgacacctccctaatccaggaaacattcacaaacaaggactcccatatacaaatactttaggaagagagatttcccaggcagatatcaccaaaaatgttttcactgtaggaatcacaaaataagtttttgtcaaaataactgttgttgaacgttatactggtcttcctcactggtgattgataagctcctttctagccagtttgtggtacttccttcattttccctagaaatgttacttgttaaatgtgtcctcaggcggtttcatctttgttgattctgcccatctaagtcataagcttctcaaatgcaagctactagctagttacacttgtaagttttccataatgacatgattttaaacataaagagttcataagaatcacttggagagactatttaaaaatgagattcctaggcccacctcagattgtgataaatctgtgtgactgactgatgcacactttttctggactataataactgatgctgctctactgctttaatacaggccaaagtaacgtggaagcgcacagcagaaaatcttcagaaagacatcaggtttgttctgattttgacaagggtaacttcttctttattaaagcaaataactggacataatcttaaaggattccacctccatcgtctttcctaacttagatcttcattgagaaattgggcaaggttaagtttacttttttctagtgctgcggttttggctcgtcttggtagtctcatcttcatttctgattctggttctggaacttcatgatcactaaatagatgttgaaaatacacgaatttagatacaagctttaaaaccagtttatttataaataaaacttttttgtttctgaaaaaaaaaaaaaaaa

SEQ ID NO: 3907 - DNA, 915 bp, Homo sapiens
acagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctgattgaaaaggaggatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtg

SEQ ID NO: 3908 - DNA, 1339 bp, Homo sapiens
acagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagccccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaagattgaaaaggaagatcaggccaaccccaaagaagaagtgaccaaggaggagtttaaactgaatgaacaaccttggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtgggaaaaaaaaagatgttatacaaccatcaaagtggcaaaaataaaaaaaatcaagtattggcaaagatgtggggaaaattctcataagctactgatgagaatttataaattattatgacacctttgggttcaatctggggatactggcaaagcagaaaattgtacaacctgtggtcaagcaataataattttaggcacccatcctagagaaaacttgaattcatagaaaaagtaggtacacgtaaatctgttcaaggaatcattgtttggcattgaaaataggagagagatcatgagaaattaccaaaatgtccaccaatagaatgagtgaatcacccgtggtatatttataaataaaatcttaaatagaaggtaaaacaaatcag

SEQ ID NO: 3909 - DNA, 2602 bp, Homo sapiens
aaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcctattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataatttttaggcacccatcctagagaaaacttgaattcatagaaaaagtaggtacacgtaaatctgttcaaggaatcattgtttggcattggaaataggagagagatcatgagaaattaccaaaatgtccaccaatagaatgagtgaatcacctgtggtatatttataaataaaaatattaaatagaaggtaaaacaaatcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataatgcaatagaataaaaatgacaacaaagtaaaagggtatcccaaaaataaaactatccttttggaaaaaaaaagatttaaaataattcctggtttgaagaaataacaaattaaaagctatatataaacggttaacaatattaggtggacatatttgtttgaagagataggtgaaagatagttgaaaagcctgggggtatattcaaggttatatgtcttaggaaacaaaaatacttgtttgggttcagttttggatctgggcttgttcttgtggcttctgatgatttctgacttggggaaaaatggggaagagttgaaatacgtccttccacccaaacctttgtttagtaataggtaggaaaatgaagaagaaaatagaatgttgcagaatgtggagggatgtaaaatggacagtactagggtagaggggaagtcagattagaggaaagaaagagcatcaggaacagtcttgtgctaggagctggtgtggccaagcacagtcggatgcccaaagatccaacaaggccatggctctgtgtccttgagtgggcacaaccattcctagccaagtttaagaggcaagtaaaaatataggggcaatgtcagatgaagtcttgttcagggtatggggctaggatgagagagaatgccacagagtatgaaggaagagtgatagatccagatgagatacagctcagagtgccacgcccccagaaagaggaatcaggcaagtactgtcccaaggcagctggagggtgagggctgagtgccctggcttcctcacttggggagaccatgggtctctgtagaaattccaatataaaggcagggaaatttgactgcatggagtcttcaggtagaaatgtttctcttgcctaaattcaggtgctaaataaacaacaaaatggtaacctctactatgaagtgtttccaatgatgggatatctgaggccattacattcctgggaataacatggtgaggtgcagggtggtggtggtggtgaaacatacgacagaccactgtaagtgagaacaaattactggcccagcccaacccacaccaaataagaaatttaatatccctttggcctgttttagattttggcaaagccaggcccatagtgcttgctgggctctctcttccacatcatccagaagacacacatttgctatggaatgattgtggaggtgagagtatagtgcatattaattcatgcaaaaagttagatattagcccagaaatgttagtaacaagaaactactgaattctctgtttgtctgttgtggaaataaaaccttctggggatgaatcaaaaaaaaaaaaaaaa

SEQ ID NO: 3910 - DNA, 5375 bp, Homo sapiens
ggggccggtctcgcgcggtctagaagtggagttgctggcggctgcggcggtgacggcggcgacggaggaggcaggcggtggggcgggggcggggactaaggattctgaggtggggagtcgggagtttctggattctttatccggaatttcaagggccgccggagggctgtcgcttctgcagtgcgtaggagcggccggggcgggaggctccgcggagccgaggcgtggagaataagaaagccttgagttttgtgaaaaaccggagaagagaaactaaaaggacagtagaaaaggcttttccagtttgcataatatttccttcatggatactttttcatagcattattatgtgatgtgagaagtttttttttttgaagtaacatggattttatactacagaatcaagagaattggcttataggaaaaattgatttataaaaagtggtacaggttttcatagataaccatgacaacatcccatatgaatgggcatgttacagaggaatcagacagcgaagtaaaaaatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactgtggccagaatgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaagccaaaaaaaaaaaaaaaaaaa

SEQ ID NO: 3911 - DNA, 1127 bp, Homo sapiens
gcagatcggcttccggttccggtgggctctgaaccctgaaaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggcaaaaaaaaaaaaaaaaaaaaaaaaaaaa

SEQ ID NO: 3912 - DNA, 2732 bp, Homo sapiens
gacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggcctacagcgggaggtggccacgcgcgccgtctcatcctcatctgagcggggctcctcgccctcccactccgccacctccgtccacacctcggtctgatgggcgagaaatatgtaatcccctggctgactaggactgttaaacatagtgtggactggatgatgccttcgacaaaccagagaagccaagttggggggagctggtgcctggagtgggccctgtgcacctcacctggcggaggctggggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcagtaaattgtaaatgta

SEQ ID NO: 3913 - DNA, 2282 bp, Homo sapiens
aggcgcagcgtggccgcgggtgggcggaactggtcgggatgagtggcggagggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaagattcatagtgaccacttagtagctagtgagaaacagcatatgctccagtgggacaacttcatgaaggagcaacccaacaaaagggctgaagtggatgaagagcacagaaaagccatggaaaggcttaaagaacaatatgctgagatggagaaggacctagcgaaattttcaaccttttaagaacttgaaccacaacaatcacaaactaatgagaagatgttcacctctctcctgaaaactattcccaccagaccgtttagcctctgcttcaagcttagcaatatattcagtggcactcttatatcagaagaaagaagtttctactggcattctgattggatatttaaagaagggtgccacatttttccagctttaagtgcctatatatgattatttgaatgaagaggagtaggaaggaaaatggaatcaatatactctttgttagtcagaattgatcatcttttccattgattagctcagagaactgtaggtatagacttcttagaaagataatttcattcatttctatacagggttaacaatagtttattattgtggcttaatgggaaggtatagaagctacctgtcatagcctccttggctgttggaaggatgtataaagtgttactgcatgagtaatgtagacaaaaaaaaaagccagctgtccttggagcagagatcacatttcagagaggtgagagtgaacacattgtctctgctgtggcaaagatggccacgctggtgtttgagctgcctcttgggaagcgttgcatattttacagtgcagcataatgccatgggcttccgtggatgggaagacacatgttaagttttgtggccttccagcacttactattttcagctttttaaagcatgcttagaaggaaaagcttaccaaaaatatattttgacatttagtttttccaagagctataatcttgcccatagtatttacctcatttttgtgtctgttttgctgtgggtaagctttataagataaataatgtctatacatgtttcgactgtttaatgagtaatcaacaaaatctgccagagagtccctctggaaccatataaagttcctggctttgaatgaaccagaagtgtttgcccacacagcaaatggtccatgttaaatgtaaatcctttttagtgttaatgtctgttctcataagcaggtatattatgatgaaacatgtaccagttctgtcatcactgtgatctttaaaaacctgcatttaacagtctaatttgaggctgggtgcagtggctcacacctgtaatctcaacactttgggaggccgaggcaggcggatcatttgaagtcaggagttcaagcctagcctggccaacatggtgaaaccccgtctctactaaaaatacaaaaattagcccggcatgttggtgcacgcttgtaatcccagctactcaggagtctgaggcacgagaatcacctgaactcaggaggcggaggttgcggtgagctgagatggcaccactgcactccagcttgggtgacagagtgagactccatctcaacaaaaaaaaaatctaactgaagaactaagttgattttttatttgccataaaccaagcaaaagtaaatgcaataatttcgagatttatggtaaacaaatttgaggtatggataaatctttcacatattttttattgctctttagtaaagaaaggcacaagaaagaaaatatccagctctcttgtgttatctcagtgtggcgactgcagaaaattgacaatgcctgcctgtgtaaatgtatggcttactgtcaaagcttcattcttggctgcatgttgaaaatgtgattaaagttaatagaggagatgaaaaaaaaaaaaaaa

SEQ ID NO: 3914 - DNA, 7787 bp, Homo sapiens
gagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgctacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagttcgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccgaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaaccgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccactgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagct

SEQ ID NO: 3915 - DNA, 4928 bp, Homo sapiens
acagtagaaagtcagaaggtcacaaagcttgcagggtaagtgacacaacttgaaactgcttggccctctttaaaaagaaataataaaatgggagagaatgaagcaagtttacctaacacgtctttgcaaggtaaaaagatggcctatcagaaggtccatgcagatcaaagagctccaggacactcacagtacttagacaatgatgaccttcaagccactgcccttgacttagagtgggacatggagaaggaactagaggagtctggttttgaccaattccagctagacggtgctgagaatcagaacctagggcattcagagactatagacctcaatcttgattccattcaaccagcaacttcacccaaaggaaggttccagagacttcaagaagaatctgactacattacccattatacacgatctgcaccaaagagcaatcgctgcaacttttgccacgtcttaaaaatactttgcacagccaccattttatttatttttgggattttgataggttattatgtacatacaaattgcccttcagatgctccatcttcaggaacagttgatcctcagttatatcaagagattctcaagacaatccaggcagaagatattaagaagtctttcagaaatttggtacaactatataaaaatgaagatgacacggaaatttcaaagaagattaagactcagtggacctctttgggcctagaagatgtacagtttgtaaattactctgtgctgcttgatctgccaggcccttctcccagcactgtgactctgagcagcagtggtcaatgctttcatcctaatggccagccttgcagtgaagaagccagaaaagatagcagccaagacctgctctattcatatgcagcctattctgccaaaggaactctcaaggctgaagtcatcgatgtgagttatggaatggcagatgatttaaaaaggattaggaaaataaaaaacgtaacaaatcagatcgcactcctgaaattaggaaaattgccactgctttataagctttcctcattggaaaaggctggatttggaggtgttcttctgtatatcgatccttgtgatttgccaaagactgtgaatcctagccatgataccttcatggtgtcactgaatccaggaggagacccttctacgcctggttacccaagtgtcgatgaaagttttagacaaagccgatcaaacctcacctctctattagtgcagcccatctctgcatccctcgttgcaaaactgatctcttcgccaaaagctagaaccaaaaatgaagcgtgtagctctctagagcttccaaataatgaaataagagtcgtcagcatgcaagttcagacagtcacaaaattgaaaacagttactaatgttgttggatttgtaatgggcttgacatctccagaccggtatatcatagttggcagccatcatcacactgcacacagttataatggacaagaatgggccagtagtactgcaataatcacagcgtttatccgtgccttgatgtcaaaagttaagagagggtggagaccagaccgaactattgttttctgttcttggggaggaacagcttttggcaatattggctcatatgaatggggagaggatttcaagaaggttcttcaaaaaaatgttgtggcttatattagcctccacagtcccataagggggaactctagtctgtatcctgtagcatcaccatctcttcagcaactggtagtagagaaaaataatttcaactgtaccagaagagcccagtgcccagaaaccaatatcagttctatacagatacaaggtgatgctgattatttcatcaaccatcttggagttcccatcgtgcagtttgcttacgaggacatcaaaacattagagggtccaagttttctctccgaggcccgtttttctacacgagcaacaaaaattgaagaaatggatcgctctttcaaccttcatgaaaccattactaagctctcaggagaagtgattttgcaaattgccaacgaacctgttctgccctttaatgcacttgatatagctttagaagttcaaaacaaccttaaaggtgatcaacccaacactcatcaactgttagccatggcgtcacgcctgcgggagagtgctgaactttttcagtctgatgagatgcgacctgctaatgatcccaaggagagagcacccatccgcatccggatgctgaatgacattctccaagacatggagaaaagctttctggtaaagcaggcaccaccaggtttttatagaaacatcctctaccaccttgatgaaaagacaagccggttttcaatacttatagaggcttgggaacactgcaaaccccttgcatcaaatgagacccttcaagaagccctgtcagaggtgttgaacagcattaattcagctcaggtttacttcaaagcaggacttgatgtgttcaagagtgtcttggatgggaagaattgagaaaactctgagcatttttaaaagtttgtttacaattccacaagcaaaagctctaatttaaccagattttctgacattgaaggcttattttccccaatggctttttgacaagtataaagctattattacattgtattttttaaatgtaaatatagaaagaacattttgcacatttaatatttttcttatatctacatttctgaatatgtaaagcaagttattgaaataggacttaagaattacctattaaaaagaaatctgatatataaaaatatgtactattttaaggaaaaatttccaagaagttctggactatctttgttcctatggggagggcatataggaacacagtttattctctctgatagagctattaatgacttagtttctgtaaaagaaatggagagttgatatggttcagattaacttcactattaagtgttcaatatgaagaattcaagtattctgactgagtgattggttgacctaaaccactttgaatgtttctattttatgagatgaagtttctcttcttaacacaactagatgtagtaatacactggttatgaaattgtatttttttaagtattaatgaaaaaagagccataagcattccaggggaaaatctcaagggagctacatagagcaatttaaatgcaaatttttttcctaacaacttacaaggtgactagctttgaaacccctaatttgcctcagttgattttctaagaatttcaggagtgatgtatgtcttaagagggagaaaaaaatatttcttattactttttctcttgtttctgttggaaacactgaagcagggactctaaaatgaaagcatctcacattggttttctttcttgtatcttttctgaaactccttgctgtaaggcagctttctcagagtactatatatttccaacagtaaagtagcagagtttctctttgaaacccaaaatgtcttctaaagaatcaaatttctatttctgcctctgacaaaaagaacttactatgaaagaaatagttgttttatcaataaaagccccttaatattatgaagaaacttttcatattttttcttctttatccttaattgtgactaagatggaaatctagaaaatattcatgcttctaagtttctgcagtgttactgtaagagagtgtctcgtctacacttcagttcttctctcatgtggaaaactaagctttttatattgacattgccattgaatagctctagcaactattattattcccccaaaccctaaaattctacctattaggtgtcaggttaaagttctaatttatctttagaaatttatgtgaaaaatggttttcctatactggataaagcaattccccttaggaaacatagcctcagagtatttcatataaattttctctatctaattcaaacatatctccccatgatacaccgccagagtgacattgcagacagtctgtgtatgtttaaattttcactttttatggatgagcataaacctagtcttagtttaaaggcaaactaaagttgaggggaaataattaatcaatactgattaattgatttataaggttcaacactgtctaccctaaataatttttatatgctcaaggcaaagcagggaatagaggcaattagctagataattcaagcagaaatccattttcatcgaaattgcctgtgtgcacatatttttagatgaaaaatgaaactaccttacaatattatttttttaatcaatgtatttgtttgcaaacatttgccatgttgaagagtgtgtataggaaaggtctagaaataaataggcttgtgcatacctaggcattcatgctctttcttcctcttcagagatcatcagaaaagaggtgggaatacacaagcaggtgcatgtaagcccaaaagctagaaagccttatatttaaccaaaggttgatgtgttcattccagttattcacttacagatgaaactaaaacaaataaaggcaagctattatcagtttggtagttcgttattttagaacaaatttctaaatgaatttattcccataacctacaatagcactgagaacagaaaacatgtttcttcttcattttgtttaaagattgcgtacctaggtaagtcacactgtatagataaaaaccttcttctgtattcctcacctctaaattatatgttatttgctatttgaaaactgtagttaactatggttttttattagtctattaaaagatacgtggagatattaaattatacctaaagcagacgtccaacaaattctgtacatgctgctttacatctttgcaacaaacctcttaactagcagcattatttctatagtgtgattacctgagggtgcctccaaatgtatatcatttcactcccctcccctccccacccccaatagattcaaataaataaaatcctgagcaaattaaaaaaaaaaaaaaaaaa

SEQ ID NO: 3916 - DNA, 1912 bp, Homo sapiens
aagatctctctggaccagctcgggtgcagggcctctgcgggagccctcctagacctctgcggcttctcctctaacatggccgactcggaaaaccaggggcctgcggagcctagccaggcggcggcagcggcggaggcagcggcggaggaggtaatggcggaaggcggtgcgcagggtggagactgtgacagcgcggctggtgaccctgacagcgcggctggtcagatggctgaggagccccagacccctgcagagaatgccccaaagccgaaaaatgactttatcgagagcctgcctaattcggtgaaatgccgagtcctggccctcaaaaagctgcagaagcgatgcgataagatagaagccaaatttgataaggaatttcaggctctggaaaaaaagtataatgacatctataagcccctactcgccaagatccaagagctcaccggcgagatggaggggtgtgcatggaccttggagggggaggaggaggaggaagaggagtacgaggatgacgaggaggagggggaagacgaggaggaggaggaggctgcggcagaggctgccgcgggggccaaacatgacgatgcccacgccgagatgcctgatgacgccaagaagtaaggggggcagagatggatgaagagaaagcccacgaagaaaaaagcctggttttgtttttcccagaatatcgatggacttaaaaaggctcaggtttttgaccaaaatacaatgtgaatttattctgacattcctaaaatagattaaattaaagcaattagatcctggccagctcgattcaaatttgactttcattttgaacataataaatatatcaaaaggtgttaaagaaaactgaattaaacccaaaattatgttttcatggtctcttctctgaggattgaggtttacaaagggtgttagcagatgcgaagtaaagaacgtcactttgaaacccattcatcacacagcatacgctacacatggaacacccaagccatgactgaacacgttctcagtgcttaattcttaaatttctttactcatgacatttcgcagtgcagagaaggcagaacccaagaaaaacgtcatctttgagactttgcttttgtaacgcagacatcagctttacacttcacaggagattgatggcattgaggaagattgcaatggagatcatgacactactgttaataaggccaggaaaactgccatttcaagttctgaaaaatgttttgagtatttgaatttagagaaacaacatggttccaagaaggagggtgtaaaacctgtaaaatactgtcaacatgtattcattagttacaatctcatgtttgtgttttcttagtactgtctatttacaaacacgtaaaaaataccccaaatatgtttaagtattaaatcactttacctagcgttttagaaatattaatttacttgaagagatgtagaatgtagcaaattatgtaaagcatgtgtatccagcgttatgtactttgcgccttgtgacgtctttctgtcatgtagcttttagggtgtagctgtgaaaatcatcagaactcttcactgaagctaatgtttggaaaaaatatatacttgaagaaccaatccaagtgtgtgcccctacccccagctcagaagtagaaagggtttaagtttgcttgtattagctgtgccttcattattttgctatgtaaatgtgacatattaattataaaatggtgcataatcaaattttactgcttgaggacagatgcatacagtaaggatttttaggaagaatatatttaatgtaaagactcttagcttctgtgtgggttttgaattatgtgtgagccagtgatctataaagaaacataagcttaaagttgtttatcactgtagtgttaataaaacagtattttcaaaaaat

SEQ ID NO: 3917 - DNA, 3798 bp, Homo sapiens
agcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagaggctatcaactgcttaaatgcagccatcgacatttacacagacatgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaattttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcatccctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttctttgctttttgtgttgttccgtatgctaacatgtgcatggcaaaaatttagaatagccagggtctgtaggcatcacattgtgaggaagggagctttctggaagtacttgcttcatgtatggatgagtgtcaaagtgaatttgatttgtacttagacacacgcgtgcacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttggtcagggctggatagattatctaagtcaagcttgagaatgaatgtatgtaattttcctgtttattgtacatgatgggttaggtggggtgaatgtggtacaggaatgtcctgtatgcccaagtgggcaagaaccccaacttgtttctcaggggacttgattgttctcttagctggtggaatatgttggcttatgtgtttgaactctgtcgtgtttaattggtttatataatatatgtatgctatcttgattcatgaacttgattctattaatttatatgctgatattgtactttagacatacgcttgtctcctgaatgtcctctgaatattttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctaggaagaaagagaaagtagcaggaaaggaagtgggaagggccagccaaggacagactgtagaggatccacatcaggtggccacgaggacttgcaggctatagttatggtggtgacatgcatgaggtgggctggtagagcaggaagctctgtgatgtcagagcatctactgggactacaggtgcactgtagtccccactactgggggtggcaatgaagacactctgtctgttgggccctagaatttaatgtggatttcctccttccttccaagttctgagattcttaaatgagagctggctgtcttctagaggtaagacctggaatggagtccagttggtactttttcactccctcttagaatctcttatgaaaaaatgatcagagagaaaagtggggttttgtttccccacctaatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtattttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcatttttgcacagtcgtgaccgtgtgtggtggcgtcactgtaaccaaagtatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtaacaataaatctaccttagcaaaaaaaaaaaaaaaa

SEQ ID NO: 3918 - DNA, 10812 bp, Homo sapiens
gcggcgtcggggcttcacaacaacagtggtggccgtagcagcggccgggccgggctgaggcgcaggcggggagcgggcccggcgccgcggcgctggtggatgctggggctccgaggcgacggccggggggcgggggccgaggcaggtataacggtaccggcggcggcagcgccgctgctcttcccttctcctcaggaggggggccaatggctagcgagaagccgggcccgggcccggggctcgagcctcagcccgtggggctcattgccgtcggggccgctggcggaggcggcgggggcagcggtggtggcggcaccgggggcagcgggatgggggagctaaggggggcgtccggctccggctcggtgatgctccccgcggggatgattaacccttcggtgccgatccgcaacatccggatgaaattcgcagtgttgattggactcatacaggtcggagaggtcagcaacagggacatcgtggagacggtgctcaacctgctggttggtggagaatttgacttggagatgaactttattatccaggatgctgagagtataacatgtatgacagagcttttggagcactgtgatgtaacatgtcaagcagaaatatggagcatgtttacagccattctacgaaaaagtgttcggaatttacagactagcacagaagttgggctaattgaacaagtattgctgaaaatgagtgctgtagatgacatgatagcagatcttctagttgatatgttgggggttcttgccagctacagcatcactgtcaaggagttgaagcttttgttcagcatgcttcgaggagaaagtggaatctggccaagacatgcagtaaaattattatcagttcttaatcagatgccacagagacacggtcctgatacttttttcaatttccctggttgtagcgctgcggcaattgccttgcctcctattgcaaagtggccttatcagaatggcttcaccttaaacacttggtttcgtatggatccattaaataatattaatgttgataaggataaaccttatctttattgttttcgtactagcaaaggagttggttactctgctcattttgttggcaactgtttaatagtcacatcattgaagtccaaaggaaaaggttttcagcattgtgtgaaatatgattttcaaccacgcaagtggtacatgatcagcattgtccacatttacaatcgatggaggaacagtgaaattcggtgttatgttaatggacaactggtatcttatggtgatatggcttggcatgttaacacaaatgatagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataagagtaccttcaagtttaaatctgagagtgatattcatttggcagaacatcataaacaggtgttatatgatgggaaacttgcaagtagcattgcctttacatataatgctaaggccactgatgctcagctctgcctggaatcatcaccaaaagagaatgcatcaatttttgtgcattccccacatgctctaatgcttcaggatgtgaaagcgatagtaacacattcaattcatagtgcaattcattcaattggagggattcaagtgctttttccactttttgcccaattggataataggcagctcaatgacagtcaagtggaaacaactgtctgtgctactctgttggcattcctggttgaactacttaaaagttcagtagccatgcaagaacagatgctgggtggaaaaggctttttagtcattggctacttacttgaaaagtcatcaagagttcatataactagagctgtcctggagcaatttttatcttttgcaaaataccttgatggtttatctcatggagcacctttgctgaagcagctttgtgatcacattttatttaacccagccatctggatacatacacctgcaaaggttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattagatggtccccggccatcacaaaaagaaattatatcactgagggcatttatgctactttttctgaaacagctgatactaaaggatcgaggggtcaaggaagatgaacttcagagtatattaaattacctacttacgatgcatgaggatgaaaatattcatgatgtgctacagttactggtggctttaatgtcggaacacccagcctcaatgataccagcatttgatcaaagaaatggaataagggtgatctacaaattattggcttctaaaagtgaaagtatttgggttcaagctttgaaggttctgggatactttctgaagcatttaggtcacaagagaaaagttgaaattatgcacacccatagtcttttcactcttcttggagaaaggctgatgttgcatacaaacactgtgactgtcaccacatacaacacactttatgagatcttgacagaacaagtatgtactcaggtcgtacacaaaccacatccagagccagattctacagtgaaaattcagaatccaatgattcttaaagtggtggcaactttgttaaaaaactctacaccaagtgcagagctgatggaagttcgtcgtttatttttatctgatatgataaaacttttcagtaacagccgtgaaaatagaagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactactacgacacaagctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggagccattctacaaagtctgtaatggattttgtcaatagcaatgaaaatattatttttgtacataacacaattcacctcatttcccaaatggtagacaacatcatcattgcttgtggaggaattttacctttgctctctgctgctacatcaccaactggttctaagacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattagtttgttgtgttgctgtgagaaactgtttagaatgtcggcaaagacagagagacaggggaaataaatcttcccatggaagcagtaaacctcaggaagttcctcaaagtgtgactgctacagcagcttcgaagactccattggaaaatgttccaggtaacctttctcctattaaggatccggatagacttcttcaggatgttgatatcaatcgccttcgtgctgttgtctttcgggatgtggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacagttgtggtcataccatctatccctcatccaagtttgaaccatggattccttgccaagttaattcctgagcagagctttggccactcattttacaaagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtgccgtggattcagggtcctcctcctcttcctcctcttctagttttgtgaatggtgctactagcaaaaaccttccagctgtacaaactgttgctccaatgccagaagattcagctgaaaatatgagcatcactgcaaaacttgaaagagcgttagaaaaagttgctcctcttcttcgtgaaatttttgtagactttgccccattcctatctcgtacacttcttggcagtcatggacaagagctattgatagaaggccttgtttgtatgaagtccagcacatctgtggttgagcttgttatgctgctttgttctcaggaatggcaaaactctattcagaagaatgcaggacttgcatttattgagctcatcaatgaaggaagattactgtgccatgctatgaaggaccatatagtccgtgttgcaaatgaagctgagtttattttgaacagacaaagagccgaggatgtacataaacatgcagagtttgagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcatagccaattgcatgatttctggcgtttggattactgggaagatgatcttcgtcgaaggagacgatttgttcgcaatgcatttggctccactcatgctgaagcattgctgaaagctgcaatagaatatggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattcaaaaaaaaaaaaaaaaaaaaa

SEQ ID NO: 3919 - DNA, 4689 bp, Homo sapiens
gagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctgattgaaaatgatcagtcgatcagccgaaatcatgctgtgttaactgctaacttttctgtaaccaacctggtatagaaaaacattttggaaatttctacagaaaaagtaaaattgttactagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataatggtggatctgtttctggactttctgtttggttacactgaaatgtttgtccatccttgcactcactcataccatactgccttgaattactgtagctgcatagatgctccttaagttgggattacattgtaataaacgcaatgtaagttaaaaaaaaaaaaaaaaaa

SEQ ID NO: 3920 - DNA, 4639 bp, Homo sapiens
gagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctgattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataatggtggatctgtttctggactttctgtttggttacactgaaatgtttgtccatccttgcactcactcataccatactgccttgaattactgtagctgcatagatgctccttaagttgggattacattgtaataaacgcaatgtaagttaaaaaaaaaaaaaaaaaa

SEQ ID NO: 3921 - DNA, 1557 bp, Homo sapiens
ggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaaaaaaaaaaaaaaaaaaaaaaaaaaaaaaaa

SEQ ID NO: 3922 - DNA, 859 bp, Homo sapiens
ggttgggcagggcaatacgcctgcgtgttgccggatgcgcatgcgcaggcgccgtgtggcactcggcggtcgaaaggggagttcaaggagacgggggcgacgcggctgagggcttctcgtcggggtcggggctgcagccgtcatgccggggatagtggagctgcccactctagaggagctgaaagtagatgaggtgaaaattagttctgctgtgcttaaagctgcggcccatcactatggagctcaatgtgataagcccaacaaggagtttatgctctgccgctgggaagagaaagatccgaggcggtgtttagaggaaggcaaactggtcaacaagtgtgctttggacttctttaggcagataaaacgtcactgtgcagagccttttacagaatattggacttgcattgattatactggccagcagttatttcgtcactgtcgcaaacagcaggcaaagtttgacgagtgtgtgctggacaaactgggctgggtgcggcctgacctgggagaactgtcaaaggtcaccaaagtgaaaacagatcgacctttaccggagaatccctatcactcaagaccaagaccggatcccagccctgagatcgagggagatctgcagcctgccacacatggcagccgcttttatttctggaccaagtaaagatgggtccgtggcccacactcggtcatgtgctcagacaacgactgatgaaaacgcccatgcggtttgcatcgactgatagtgtgttctttccgggatcacaaacattaacaaaaaagttaacttatgtgacttggcagttattctataccatttcctgtccattaaaatttttaaaggaaaaaaaaaaaaaaaaaa

SEQ ID NO: 3923 - DNA, 541 bp, Homo sapiens
gcacttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatatgtattcctgcctaaataaatcatctattaatcattaaaaaaaaaaaaaaaa

SEQ ID NO: 3924 - DNA, 1056 bp, Homo sapiens
ggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttttttttgagacagggtctcactctgtcacccaggctggagtgcagtggcacattctcggctcactgcaacttccgcctcctgggttcaagtgattctcccacctcagcctcccaagtaggtgggattacaggtactcaccaccaggtccagctaacttttgtatttttagtagagacagggtttcaccatgttggccaggctggtctcgaactcctgacctcagatggtctgcccacctccgcctcccaaagtgctgggattacaggcgtgagccactgcgcccggccactttcacactttttacagtgagtggtgaattagcaacagtaacactgattatccaacatatattttggaatatctactatgtgcaaggaatttttcttaaactctaaggttatgaatcactgggcaaatccatataattagagaattttaagtgctttagagcggtgtgattctactgtgctcagcctagtcaatttcgcattaaactgattatcagctgaaaaaaaaaaaaaaaaaaaaaa

SEQ ID NO: 3925 - DNA, 2151 bp, Homo sapiens
ggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattgtctaaaaacttatcttcacccagttcttacccgccagctgtgaataagggcaggaaggtagctagtcccagtcccagtggcagcgtgctattcacagatgaaggggttccgaaatttttgtcaagaaagactttggtagagtttccacagaaagttctgtctccattcagaaaacagggctctgattcagaagctcgtcaggtgggtcggaaagtgacgtcgccttcgtcttcatcctcttccagctcctctgattctgaatctgatgatgaggctgacgtttcagaggtcactcctcgagtggtgagcaaaggcagaggggggcttcgaaaaccagaggcctctcattcctttgaaaacagagccccccgagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcgccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccgagggcgaggccatggaagatgcagccgcgccaggggacgaccgaggcggcacacaggagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttttttttgagacagggtctcactctgtcacccaggctggagtgcagtggcacattctcggctcactgcaacttccgcctcctgggttcaagtgattctcccacctcagcctcccaagtaggtgggattacaggtactcaccaccaggtccagctaacttttgtatttttagtagagacagggtttcaccatgttggccaggctggtctcgaactcctgacctcagatggtctgcccacctccgcctcccaaagtgctgggattacaggcgtgagccactgcgcccggccactttcacactttttacagtgagtggtgaattagcaacagtaacactgattatccaacatatattttggaatatctactatgtgcaaggaatttttcttaaactctaaggttatgaatcactgggcaaatccatataattagagaattttaagtgctttagagcggtgtgattctactgtgctcagcctagtcaatttcgcattaaactgattatcagctgaaaaaaaaaaaaaaaaaaaaaa

SEQ ID NO: 3926 - DNA, 8959 bp, Homo sapiens
ccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactgtaccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccaatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttggaggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaat

SEQ ID NO: 3927 - DNA, 2834 bp, Homo sapiens
tttgctaggcagcggcagtggcggcggcagcggcggctggagcctcctgattgggtttcggagtccggtactggagccaatcagcgcgggcagcgaaccgggggagcgaggcacggagtgtacctcacagccttctaggatctccagagtggacaggaatctcacttggagggaccatggagcagtatacagcaaacagcaatagttcgacagagcagattgttgtccaggcaggacagattcagcagcagcagcagggtggtgtcactgctgtgcagttgcagactgaggcccaggtggcatccgcctcaggccagcaagtccagaccctccaggtagtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaaatacagttggtcccacctggacagatccagatccagggtggacaggctgtgcaggtgcagggccagcagggccagacccagcagatcatcatccagcagccccagacggctgtcactgctggccagactcagacacagcagcagattgctgtccagggacagcaagtggcacagactgctgaagggcagaccatcgtctatcaaccagttaatgcagatggcaccattctccagcaagttacagtccctgtttcaggcatgatcactatcccagcagccagtttggcaggagcacagattgttcaaacaggagccaataccaacacaaccagcagtgggcaagggactgtcactgtgacactaccagtggcaggcaatgtggtcaattcaggagggatggtcatgatggttcctggggctggctctgtgcctgctatccaaagaatccctctacctggagcagagatgcttgaagaagagcctctctacgtgaatgccaaacaataccaccgtattcttaagaggaggcaagcccgagctaaactagaggcagaagggaaaattccaaaggagagaaggaaatacctgcatgagtctcggcaccgtcatgccatggcacggaagcgtggtgaaggtggacgatttttctctccaaaggaaaaggatagtccccatatgcaggatccaaaccaagccgatgaagaagcaatgacacagatcatccgagtgtcctaaccccacgccatgtgatggagctgatcaaggtcatgtttctcactgttccaggaaattgatcaactcttccaatgggacattgatgatcacattctgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagatagcatttatccctctggtgggggaatctcacactgactaactgaatggacgctttgtattcagagatggcttccaggcaaggaagttctatcttgtgatacggaaacaataaattcctgagatacattcttccaatctgtggtaataataagaattcctctctgcccagatggtaggttgatatttctggactctagccaagaaaaagctaattctggggatagaatgataaaagactcaagcactaaaaatatacattgccgaatctctttttctagctttgaaaagttgtggcctgcttgtccctctgttgactggtcatctggaccatcgtacttgctgtggctacttctaagacaatgtagagggttattaaaccttgaaactgcctttcctaagtagagaacaagactattcaacaacttctttgctgaagcactgaggagatttgtaatactcctaaaggaagggccaaactagagattttcaatcatagactttgtgacagcatttggggaactaaaagattcatgtgtttcagcctagtgggagagagtgggggagaggaagagagagagagagcatgtatacccgtatgttatcatagagcacgattctccagtggatggatacctggaatggatcattaagatgaagagagtaattcacatttactctagaacctttaacaagcactgaaaggaagaagcctgagatttgatccttgacaatttctggaaagcactggtcagtcacactgtcctggacagagtccaagttacccactaaagcttgaggtggatgttggcttcactcctgcagcacaatgctggccctagaaagcgagcattttcattcttcccatggcagctgattctttggtgccagttttcatgttttctccataggccttgtgcagaaaggttttctcattgcatccatactgtgagaataaactgcagactgaaagaaacatgcctgcagggtcaggaactgggccactgttcccagaacgggttgtgcctcagaaatctatttctcttttagatgttgaaccctgagagaactaagatgatatttcagaagagttggctgccttctctggaaacaaggaaaacccaataattccgaggaacattgggggttaaataccaagaataaaaattggttcttctttgaaaaaaaaaaagaaaaaaaaaaaaaaaa

SEQ ID NO: 3928 - DNA, 2747 bp, Homo sapiens
tttgctaggcagcggcagtggcggcggcagcggcggctggagcctcctgattgggtttcggagtccggtactggagccaatcagcgcgggcagcgaaccgggggagcgaggcacggagtgtacctcacagccttctaggatctccagagtggacaggaatctcacttggagggaccatggagcagtatacagcaaacagcaatagttcgacagagcagattgttgtccaggcaggacagattcagcagcaggtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaaatacagttggtcccacctggacagatccagatccagggtggacaggctgtgcaggtgcagggccagcagggccagacccagcagatcatcatccagcagccccagacggctgtcactgctggccagactcagacacagcagcagattgctgtccagggacagcaagtggcacagactgctgaagggcagaccatcgtctatcaaccagttaatgcagatggcaccattctccagcaagttacagtccctgtttcaggcatgatcactatcccagcagccagtttggcaggagcacagattgttcaaacaggagccaataccaacacaaccagcagtgggcaagggactgtcactgtgacactaccagtggcaggcaatgtggtcaattcaggagggatggtcatgatggttcctggggctggctctgtgcctgctatccaaagaatccctctacctggagcagagatgcttgaagaagagcctctctacgtgaatgccaaacaataccaccgtattcttaagaggaggcaagcccgagctaaactagaggcagaagggaaaattccaaaggagagaaggaaatacctgcatgagtctcggcaccgtcatgccatggcacggaagcgtggtgaaggtggacgatttttctctccaaaggaaaaggatagtccccatatgcaggatccaaaccaagccgatgaagaagcaatgacacagatcatccgagtgtcctaaccccacgccatgtgatggagctgatcaaggtcatgtttctcactgttccaggaaattgatcaactcttccaatgggacattgatgatcacattctgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagatagcatttatccctctggtgggggaatctcacactgactaactgaatggacgctttgtattcagagatggcttccaggcaaggaagttctatcttgtgatacggaaacaataaattcctgagatacattcttccaatctgtggtaataataagaattcctctctgcccagatggtaggttgatatttctggactctagccaagaaaaagctaattctggggatagaatgataaaagactcaagcactaaaaatatacattgccgaatctctttttctagctttgaaaagttgtggcctgcttgtccctctgttgactggtcatctggaccatcgtacttgctgtggctacttctaagacaatgtagagggttattaaaccttgaaactgcctttcctaagtagagaacaagactattcaacaacttctttgctgaagcactgaggagatttgtaatactcctaaaggaagggccaaactagagattttcaatcatagactttgtgacagcatttggggaactaaaagattcatgtgtttcagcctagtgggagagagtgggggagaggaagagagagagagagcatgtatacccgtatgttatcatagagcacgattctccagtggatggatacctggaatggatcattaagatgaagagagtaattcacatttactctagaacctttaacaagcactgaaaggaagaagcctgagatttgatccttgacaatttctggaaagcactggtcagtcacactgtcctggacagagtccaagttacccactaaagcttgaggtggatgttggcttcactcctgcagcacaatgctggccctagaaagcgagcattttcattcttcccatggcagctgattctttggtgccagttttcatgttttctccataggccttgtgcagaaaggttttctcattgcatccatactgtgagaataaactgcagactgaaagaaacatgcctgcagggtcaggaactgggccactgttcccagaacgggttgtgcctcagaaatctatttctcttttagatgttgaaccctgagagaactaagatgatatttcagaagagttggctgccttctctggaaacaaggaaaacccaataattccgaggaacattgggggttaaataccaagaataaaaattggttcttctttgaaaaaaaaaaagaaaaaaaaaaaaaaaa

SEQ ID NO: 3929 - DNA, 5065 bp, Homo sapiens
gccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgcagttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactacgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctgagggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtcccagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaagattcagaccccactccggggaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgggatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgctggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatgaaaaaaaaaaaaaaaaaaaa

SEQ ID NO: 3930 - DNA, 3905 bp, Homo sapiens
gccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactcccaaaaaaaaaaaa

SEQ ID NO: 3931 - DNA, 2762 bp, Homo sapiens
gggggggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccaagcagctgtggccaccacccgaggggaccaggaaagtgctgaggccaacaaattccaggtcacggacagtgctgcattcaatgctctggttaccttctgcatcagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcgagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacactgagggattctcggagagagggatactgaggcccctgagcactcggcatggggtggaagacgatgaagaggacgaggaggagggcgaggaggacagcagcaactcggaggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcaggaaaaaaaaaaaaaaaaaaa

SEQ ID NO: 3932 - DNA, 3414 bp, Homo sapiens
tgagaactcaggctggcacagggattcccagggcatctaccaccacgcagctggagcagggctgagcccaggagcatggagatggacgcccccaggccccccagtcttgctgtccctggagcagcatcgaggcccgggaggctgctggatggggggcacggcaggcagcaggttcaggccctctcttcacagctcctggaggtgatccccgactccatgaggaagcaagaggtgcggacgggcagggaggccggccagggccacggtacgggctccccagccgagcaggtgaaagccctcatggatctgctggctgggaagggcagtcaaggctcccacgccccgcaggccctggataggacaccggatgccccgctggggccctgcagcaatgactcaaggatacagaggcaccgcaaggccctgctgagcaaggtgggaggtggcccggagctgggcggaccctggcacaggctggcctccctcctgctggtggagggcctgacggacctgcagctgagggaacacgacttcacacaggtggaggccacccgcgggggcgggcaccccgccaggaccgtcgccctggaccggctcttcctgcctctctcccgggtgtctgtcccaccccgggtctccatcactatcggggtggccggcatgggcaagaccaccctggtgaggcacttcgtccgcctctgggcccatgggcaggtcggcaaggacttctcgctggtgctgcctctgaccttccgggatctcaacacccacgagaagctgtgtgccgaccgactcatctgctcggtcttcccgcacgtcggggagcccagcctggcggtggcagtcccagccagggccctcctgatcctggacggcttggatgagtgcaggacgcctctggacttctccaacaccgtggcctgcacggacccaaagaaggagatcccggtggaccacctgatcaccaacatcatccgtggcaacctctttccggaagtttccatctggatcacctcccgtcccagtgcatctggccagatcccagggggcctggtggaccggatgacggagatccggggctttaacgaggaggagatcaaggtgtgtttggagcagatgttccccgaggaccaggcccttctgggctggatgctgagccaagtgcaggctgacagggccctgtacctgatgtgcaccgtcccagccttctgcaggctcacggggatggcgctaggccacctgtggcgcagcaggacggggccccaggatgcagagctgtggcccccgaggaccctgtgcgagctctactcatggtactttaggatggccctcagcggggaggggcaggagaagggcaaggcaagccctcgcatcgagcaggtggcccatggtggccgcaagatggtggggacattgggccgtctggccttccatgggctgctcaagaagaaatacgtgttttacgagcaagacatgaaggcgtttggtgtagacctcgctctgctgcagggcgccccgtgcagctgcttcctgcagagagaggagacgttggcatcgtcagtggcctactgcttcacccacctgtccctgcaggagtttgtggcagccgcgtattactatggcgcatccaggagggccatcttcgacctcttcactgagagcggcgtatcctggcccaggctgggcttcctcacgcatttcaggagcgcagcccagcgggccatgcaggcagaggacgggaggctggacgtgttcctgcgcttcctctccggcctcttgtctccgagggtcaatgccctcctggccggctccctgctggcccaaggcgagcaccaggcctaccggacccaggtggctgagctcctgcagggctgcctgcgccccgatgccgcagtctgtgcacgggccatcaacgtgttgcactgcctgcatgagctgcagcacaccgagctggcccgcagcgtggaggaggccatggagagcggggccctggccaggctgactggtcccgcgcaccgcgctgccctggcctacctcctgcaggtgtccgacgcctgtgcccaggaggccaacctgtccctgagcctcagccagggcgtccttcagagcctgctgccccagctgctctactgccggaagctcaggctggacaccaaccagttccaggaccccgtgatggagctgctgggcagcgtgctgagtgggaaggactgtcgcattcagaagatcagcttggcggagaaccagatcagtaacaaaggggccaaagctctggccagatccctcttggtcaacagaagtctgacctctctggacctccgcggtaactccattggaccacaaggggccaaggcgctggcagacgctttgaagatcaaccgcaccctgacctccctgagcctccagggcaacaccgttagggatgatggtgccaggtccatggctgaggccttggcctccaaccggaccctctccatgctgcacctgcagaagaacagcatcgggcccatgggagcccagcggatggcagatgccttgaagcagaacaggagtctgaaagagctcatgttctccagtaatagtattggtgatggaggtgccaaggccctggctgaggccctgaaggtgaaccagggcctggagagcctggacctgcagagcaattccatcagtgacgcaggagtggcagcactgatgggggccctctgcaccaaccagaccctcctcagcctcagccttcgagaaaactccatcagtcccgagggagcccaggccatcgctcatgccctctgcgccaacagcaccctgaagaacctggacctgacagccaacctcctccacgaccagggtgcccgggccatcgcagtggcagtgagagaaaaccgcaccctcacctcccttcacctgcagtggaacttcatccaggccggcgctgcccaggccctgggacaagcactacagctcaacaggagcctcaccagcttagatttacaggagaacgccatcggggatgacggagcgtgtgcggtggcccgtgcactgaaggtcaacacagccctcactgctctctatctccaggtggcctcaattggtgcttcaggcgcccaggtgctaggggaagccttggctgtgaacagaaccttggagattctcgacttaagaggaaatgccattggggtggctggagccaaagccctggcaaatgctctgaaggtaaactcaagtctccggagactcaatcttcaagagaattctctggggatggacggggcgatatgcattgccacagcactgtctggaaaccacaggctccagcatatcaatctccagggaaaccacattggggactccggggccaggatgatctcagaggccatcaagacaaatgctcccacgtgcactgttgaaatgtga

SEQ ID NO: 3933 - DNA, 1295 bp, Homo sapiens
ctccacttctccccgcccaccctgccggaggctgctcctgattggcttcccggccgcggggctcaggttacattcgcgagcggagccgagcgcgggagaccggacccgagagcagagctgctgtttcggcgcgggtcggctggcggccgatgccccagagcccccacccggcaccacacagaccccatccccgccctgcgccaccttcgtccccgcagaggacccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagtaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgccctgtcggtcccgccctccccccccgccgggctcctggggctgtggccgaaaggtttctgatctccgtgtgtgcatgtgactgtgctgggttggaatgtgaacaataaagaggaatgtccaa

SEQ ID NO: 3934 - DNA, 3572 bp, Homo sapiens
ctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctgcaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagcaaaaaaaaaaaaaaaaaaaa

SEQ ID NO: 3935 - DNA, 3158 bp, Homo sapiens
gttttagggacagactgcttccgggtcgaagggcttgcttccggagagcgggaaggctaaaacgcggtagctaaactgcagccaactttggttgtgtgtggaaaaggctttagccatggacaggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcagatttggatgttgcaacaataacaaaaactgtagttgagaatattcgaaagaaagataatggtgaatttagtcatcatgacctggccccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgtttttacaaattccaaaaaaaaaaaaaaaaaaaaaaaaaaaaaaaaaaa

SEQ ID NO: 3936 - DNA, 2918 bp, Homo sapiens
aagtaattgtccgtgtcaggaaggtaggcgtgccaagccgcggctctgcggagaaaccacgaccaccgcggccgccggaaacccaaagcgctccagagcgtccccgggtggccgggcagcaccagggacagcgcccgggactccactggggaccggctcctgggcttcccagcgtcgcgggtagaggtacagctgctccgtgtgccgcaggctccagattctcgccaccccacccctccctcagaaactcggactgctctcgtctgccgtgtggttctcttttcttccgaaaggccagtgtcttatctctccacttcaagtccagaggacttgctcagtctcctccccttaagtcatttccaccatcctcaggcagctgtgggaagccgagagtcctggactgttcgtccgggtgccagcgctggcagtcccagtccgtccggtgcagcagcccggcgcattcccctctctccctccctcttgctctccctccctttctgtcttcctctctttcctcctctactgctccctccctctcttgcctcttaagtttcctgcaccgtgaatccaactgtgccaagccttggctcccgcgaaccaatcctgagcgcgacccgggcactgggacggcgactccgccaaagctggacgaggcagccggacccgtctgcgctcgagcatggagacggagcgcctgggagggcacgtccggggcgctggagacgccaggcccgagtagcttctccatggagcctgcccagagcggtcccttctcgcaggattcgccccaagtcctgtgcggctgctgagagcgctccttgctctgtaaagtggatgtcaggtggatctatgtttctgaaggaacaaagactcaaagaaggcaccgccaaggaagtttgagacgcgggagaatgcaggctgcgtgctggtacgtgcttttcctcctgcagcccaccgtctacttggtcacatgtgccaatttaacgaacggtggaaagtcagaacttctgaaatcaggaagcagcaaatccacactaaagcacatatggacagaaagcagcaaagacttgtctatcagccgactcctgtcacagacttttcgtggcaaagagaatgatacagatttggacctgagatatgacaccccagaaccttattctgagcaagacctctgggactggctgaggaactccacagaccttcaagagcctcggcccagggccaagagaaggcccattgttaaaacgggcaagtttaagaaaatgtttggatggggcgattttcattccaacatcaaaacagtgaagctgaacctgttgataactgggaaaattgtagatcatggcaatgggacatttagtgtttatttcaggcataattcaactggtcaagggaatgtatctgtcagcttggtaccccctacaaaaatcgtggaatttgacttggcacaacaaaccgtgattgatgccaaagattccaagtcttttaattgtcgcattgaatatgaaaaggttgacaaggctaccaagaacacactctgcaactatgacccttcaaaaacctgttaccaggagcaaacccaaagtcatgtatcctggctctgctccaagccctttaaggtgatctgtatttacatttccttttatagtacagattataaactggtacagaaagtgtgccctgactacaactaccacagtgacacaccttactttccctcgggatgaaggtgaacatgggggtgagactgaagcctgaggaattaaaggtcatatgacagggctgttacctcaaagaagaaggtcacatctgttgcctggaatgtgtctacactgctgctcttgtcaactggctgcaaaatacactagtggaaaacactctgatgtaatttctgcccagtcagcttcatccctcagtataattgtaaatcatcacagattttgaagtcacacctgaagacatgctctcacatatagaggtacacaaacacaccgtcatgcacatttcagcttgcgtctatcatgattcctgttgagagggctttcattgtctgactcataatggttcaggatcaactatcatcaaacggaaggattaactagacagagaatgtttctaacagttgctgttatggaaatctcttttaaagtcttgagtacatgctaatcaataatctccactcatgcattcctactgcttggagtagctgtactggtaaatactactgtaggagtatctgcttgttaaaatggaaaaatgtgtctttagagctcagtattctttattttacaaacacaacaaaatgtagtaacttttttccagcatacagtaggcacattcaaagtggtccaagatggctcttttttctttgaaaggggcctgttctcagtaaagatgagcaaacatttggaatttacatgtgggcagacattgggataacaactttcatcaccaatcattggacttttgtgaagtcgacaccagctaaggctgcttaaaataagttctgatcattatataagaagggaaatgcctggcagacaccatgtaagttataagtgtctgtcttatctttactacacatattgtaacaaattcaatatcctagtcttcatttgtatgaatggtttgtattgtacatagtttaaccaagtgttatttgagctgcttattaatattaacttgtacttgtctctctgcttgttattggttaagaaaaaaggatatgaggaattcattttatcaatgtagctgtgaaggccattaaaaagacaaacttaatgtacagagcatttattcagatcaagtattgttgaaagctatacatatacaacattacagtctgtctgtatttagatattttatttctggaaaaaatgaaatgtacataaaaataaaacacttaaagttgagtttca

SEQ ID NO: 3937 - DNA, 887 bp, Homo sapiens
gttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgccatcc

SEQ ID NO: 3938 - DNA, 1920 bp, Homo sapiens
agctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaaaatacactaagaagtctcgaggttctcaacctcagtagtaacaaactttggacagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggcttttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcaaaaaaaaaaaaaaaaaaaaaaaaaaaaaaaaaaaaaaaaaaaaaaaaaaa

SEQ ID NO: 3939 - DNA, 2250 bp, Homo sapiens
gagggcgggggaggagtgaagaggttgaggcgccccgcccagtcagcaaggttgcgcgtgccctgtgagaccgccaagatggtggtgggcgcgttccctatggcgaagctgctatacttgggcatccggcaggtcagcaagccgcttgccaaccgtattaaggaggccgcccgccgaagcgagttcttcaagacctatatctgcctcccgccggctcaactgtaccactggctggagatgcggaccaaaatgcgcatcatgggtttcaatgccgctgccatcaagccgctgaacgagggtgcagccgccgagctgggcgcggagctgctgggcgagggcatcatcttcatcaccgcctgcagctgcctgatgctggagtattggcgccaccagttgcagcagcgccgcaaggaaaaggagcgacgtgttgccagggaggcgctgcggggcgaggtgggccacttggagctggcgctcgaggagttgcaggcgcaggtgcaggcgacgtcgacgcagctcgccctggaggagctgcgcgctcagctgcaggaggtgcgagcccacctctgcctccgagacccgccgcctgcacccccagttgcgccggcgtccgagaaataggaggtctcggggccctggtcttggaggtgactgctgtctggactgcgaagtctctgtcttggcctattctccgcactgtcccatcctggaccggcccagctgacaccacccagtccttcgggggcgccggagagatcctgggctggagctgatcgaacctccctactaacctgcccagtggtaccttccactgggactctccgcctcctgcaggtggaacgttccaagaaggaccccgccctatcccaccccgcccctgccagcgcatttgttgagcactttggaaagacagcgtcttttatcagaccccacctccctaccgctaggtaggccagcaggacgtccacctcttttggcaaaacaaaattctgcacccggatttagccacctctcattctgtcacccgcaccctcactcacctgagtggacccttcccctaggacgctcatcctttgcaccgaacaccacctacctcctcctcattggtacagaccattgtaaagatgcacaaagttcctacggacttcccgacccgcccccttccatctacctcagtcttagggggaaaggtgggggtgaatcctggactgcgttagctccaatgagtcaccaccctgcggctcctgaccttaatccatcttagtacctgtcattgacatcctcccctccctgagtggatcgatccaacataacccccctcttcttccgcctatggcgcaccccactggcatggctatgctgggtcttccagggaaacgcctcccagcccggcattctgtggtctgttccagcaggacgtggccttttgggaggaaaaaccggtcttgaccagggctagtccattctggctttcaggctcagtcacttggtcaccagtccccagtcctggacctactgctactgtccttttatccggtcctccctcgctgtcctcttcagttgcctttgctagggaccggcctgtccctttactacctaagtcatcgtcagttcgcccaacttccctccaaatctgcccctcacggtacgcagggatcgcccttccttcctgcctttggactggtccaggtcctcctccgccctccttcacgcaaaggcctcctccagggggactacctgtccctcagcccagaggtccccctgtccaagcggggtattccaccaggccatatgacctacccacccgacaactgaagggggcgtggatgagctctgtgactctgaatgctactttataaatcgactgtcagcgttttctaattaaaggagctctggggtaaagatcttaagaacgtgtctgagaaccataatgtgcgtctgcaaaatgtcattgaaattaggaaagaaggccggacacagtggctcacgcctgtaattccagcactttaagaggccaaagcaggaggactgctggaggccaggagttagagaccagcctaggcaacacagcaagaccgcatctctacgaaaaatgaaaatattagctaggcgtcataccaaacgcctgtagttccagctacttgggaggctgaggcaggaggatcccttgagcccaggagttcaaggctgcagtgagctgtgatcctgccactacactccagactgggtgaaagagcaagactccaactc

SEQ ID NO: 3940 - DNA, 1584 bp, Homo sapiens
gttgaggcgccccgcccagtcagcaaggttgcgcgtgccctgtgagaccgccaagatggtggtgggcgcgttccctatggcgaagctgctatacttgggcatccggcaggtcagcaagccgcttgccaaccgtattaaggaggccgcccgccgaagcgagttcttcaagacctatatctgcctcccgccggctcaactgtatcactgggtggagatgcggaccaagatgcgcatcatgggcttccggggcacggtcatcaagccgctgaacgaggaggcggcagccgagctgggcgcagagctgctgggcgaagccaccatcttcatcgtgggcggcggctgcctagtgctggagtactggcgccaccaggcgcagcagcgccacaaggaggaggagcagcgtgctgcctggaacgcgctgcgggacgaggtgggccacctggcgctggcgctggaagcgctgcaggcgcaggtgcaggcggcgccgccacagggcgccctggaggaactgcgcacagagctgcaagaggtgcgcgcccagctctgcaatcccggccggtccgcttcccacgcagtgcctgcgtccaagaaataggagcttgctggatggaacctgaatttggacatggcctatgtacctaacgtggccttcttcccgcaccacccttgcctgcgctggcccagtggaaaccaccaggatcttgatgcaacttggcatttggttacccctgctgataagagcagccattacctgccactgggaccagcaggtgaagcgttgcaacatagccccctccatcatccttcacctcctatcccccactccaaaccaggacgacctgcaaggtcccagccagcaggacaccgtgggcactctggcaaatgaaaaaatggaacctggtcttgagctgaatcaatgtgttattgttacccccacccccggtttacctgatcagtgttaacctttactgggacactcatctgttacactggaacaccttcttctttttgtcaatcggcacagaccactgtaaggaaatgcagtgtgttgcagtggccttttctccccctcaccttctaaggtcagctctagctgagcatcagtgctctcttaaggaggaaaaaaacggtgcggctgggagcggtggctcacgcctgtaatcctagcaccttgggaggccgaggcgggcggatcacttgaggtcaggagttccagaccagcctggccaacatggtgaaactccgtctctactaaaaatacaaaaattagccgggtgtggtggggtgcgcttgtaatcccagctactcgggaggctgaggcaggagaattgcttgaacccatgaggtggaggttgcggtgagccaagatggcaccattgcaccctagcctgggcaacagagcaagacaccgtcttaaaaccaaaagttaaccgggcgtggtggtgggtgcctgtaatcctagctacttgggaggctgaggcaggagaattgcttgaacttgggaggtggaggccaagattgtaccactgtattccagcccgggtgacagagcaagactgtgtctcaaaaaaaaaaaaaaaaaaa

SEQ ID NO: 3941 - DNA, 2341 bp, Homo sapiens
agcagctccaggctggatctgcgccggacacaggagaaagcagcgggtaggctaagcaggggtgctgaggatggaggaaagttgggaggctgagcacagctgaagtcctgagctccctgtgcccttgacttctctgtgggctcgagcaaggaccatcccaactcaggatgaaccctccttcggggccaagagtcccgcccagcccaacccaagagcccagctgcatggccaccccagcaccacccagctggtgggacagctcccagagcagcatctccagcctgggccggcttccatccatcagtcccacagcacctgggacttgggctgctgcctgggtccccctccccacggttgatgttccagaccatgcccactataccctgggcacagtgatcttgctggtgggactcacggggatgctgggcaacctgacggtcatctataccttctgcagagctgtgcttcgtggagtcactgtgatgatgcagagcagaagcctccggacacctgccaacatgttcattatcaacctcgcggtcagcgacttcctcatgtccttcacccaggcccctgtcttcttcaccagtagcctctataagcagtggctctttggggagacaggctgcgagttctatgccttctgtggagctctctttggcatttcctccatgatcaccctgacggccatcgccctggaccgctacctggtaatcacacgcccgctggccacctttggtgtggcgtccaagaggcgtgcggcatttgtcctgctgggcgtttggctctatgccctggcctggagtctgccacccttcttcggctggagcgcctacgtgcccgaggggttgctgacatcctgctcctgggactacatgagcttcacgccggccgtgcgtgcctacaccatgcttctctgctgcttcgtgttcttcctccctctgcttatcatcatctactgctacatcttcatcttcagggccatccgggagacaggacgggctctccagaccttcggggcctgcaagggcaatggcgagtccctgtggcagcggcagcggctgcagagcgagtgcaagatggccaagatcatgctgctggtcatcctcctcttcgtgctctcctgggctccctattccgctgtggccctggtggcctttgctgggtacgcacacgtcctgacaccctacatgagctcggtgccagccgtcatcgccaaggcctctgcaatccacaaccccatcatttacgccatcacccaccccaagtacagggtggccattgcccagcacctgccctgcctgggggtgctgctgggtgtatcacgccggcacagtcgcccctaccccagctaccgctccacccaccgctccacgctgaccagccacacctccaacctcagctggatctccatacggaggcgccaggagtccctgggctcggagagtgaggtgggctggacacacatggaggcagcagctgtgtggggagctgcccagcaagcaaatgggcggtccctctacggtcagggtctggaggacttggaagccaaggcaccccccagaccccagggacacgaagcagagactccagggaagaccaaggggctgatccccagccaggaccccaggatgtaggacgcccactggctctccctttcttctgagacacatccagcccccccacgtctccctcatatacacagacccaggattatgctgtgagcctgcaggctttggaagtggccctgtcacccgtgctgcacgggattcacagccccagccccatggcccctctccacacctcaaaactcctgccccataacgtcctccgcatccactttccagctcagcagccgcacccgaggctcagcctgaggggtatgtgcccaggccctcccacttcccgagttgtctgcctctcctcaaatgctgtgtgctgcaattgtccaggcgatgacaatggtgatggctccagagaacacaccagctatttatgagcctctgcccccaggctgggcctgtcactggcataggaaggccagccccgcatctcccactgccaacagctgaagccgagcacagacctccctttgcacgctggaacagttactcacctgtggcttcttcccccagtgtaccgttccactgtggcccacattcttgtgcacgcgggcatttgcaggcacgctctcgcgtagttacctatctgaatgcacaccaagcacatgcgtgcacactctgcgtctgtgattcatttcatgtagtggtctaagctcctcccagggctgtgtggatctgacagggtataggaaaataaaaagcggagaaggtgtcttcag

SEQ ID NO: 3942 - DNA, 2308 bp, Homo sapiens
agcagctccaggctggatctgcgccggacacaggagaaagcagcgggtaggctaagcaggggtgctgaggatggaggaaagttgggaggctgagcacagctgaagtcctgagctccctgtgcccttgacttctctgtgggctcgagcaaggaccatcccaactcaggatgaaccctccttcggggccaagagtcccgcccagcccaacccaagagcccagctgcatggccaccccagcaccacccagctggtgggacagctcccagagcagcatctccagcctgggccggcttccatccatcagtcccacagcacctgggacttgggctgctgcctgggtccccctccccacggttgatgttccagaccatgcccactataccctgggcacagtgatcttgctggtgggactcacggggatgctgggcaacctgacggtcatctataccttctgcaggagcagaagcctccggacacctgccaacatgttcattatcaacctcgcggtcagcgacttcctcatgtccttcacccaggcccctgtcttcttcaccagtagcctctataagcagtggctctttggggagacaggctgcgagttctatgccttctgtggagctctctttggcatttcctccatgatcaccctgacggccatcgccctggaccgctacctggtaatcacacgcccgctggccacctttggtgtggcgtccaagaggcgtgcggcatttgtcctgctgggcgtttggctctatgccctggcctggagtctgccacccttcttcggctggagcgcctacgtgcccgaggggttgctgacatcctgctcctgggactacatgagcttcacgccggccgtgcgtgcctacaccatgcttctctgctgcttcgtgttcttcctccctctgcttatcatcatctactgctacatcttcatcttcagggccatccgggagacaggacgggctctccagaccttcggggcctgcaagggcaatggcgagtccctgtggcagcggcagcggctgcagagcgagtgcaagatggccaagatcatgctgctggtcatcctcctcttcgtgctctcctgggctccctattccgctgtggccctggtggcctttgctgggtacgcacacgtcctgacaccctacatgagctcggtgccagccgtcatcgccaaggcctctgcaatccacaaccccatcatttacgccatcacccaccccaagtacagggtggccattgcccagcacctgccctgcctgggggtgctgctgggtgtatcacgccggcacagtcgcccctaccccagctaccgctccacccaccgctccacgctgaccagccacacctccaacctcagctggatctccatacggaggcgccaggagtccctgggctcggagagtgaggtgggctggacacacatggaggcagcagctgtgtggggagctgcccagcaagcaaatgggcggtccctctacggtcagggtctggaggacttggaagccaaggcaccccccagaccccagggacacgaagcagagactccagggaagaccaaggggctgatccccagccaggaccccaggatgtaggacgcccactggctctccctttcttctgagacacatccagcccccccacgtctccctcatatacacagacccaggattatgctgtgagcctgcaggctttggaagtggccctgtcacccgtgctgcacgggattcacagccccagccccatggcccctctccacacctcaaaactcctgccccataacgtcctccgcatccactttccagctcagcagccgcacccgaggctcagcctgaggggtatgtgcccaggccctcccacttcccgagttgtctgcctctcctcaaatgctgtgtgctgcaattgtccaggcgatgacaatggtgatggctccagagaacacaccagctatttatgagcctctgcccccaggctgggcctgtcactggcataggaaggccagccccgcatctcccactgccaacagctgaagccgagcacagacctccctttgcacgctggaacagttactcacctgtggcttcttcccccagtgtaccgttccactgtggcccacattcttgtgcacgcgggcatttgcaggcacgctctcgcgtagttacctatctgaatgcacaccaagcacatgcgtgcacactctgcgtctgtgattcatttcatgtagtggtctaagctcctcccagggctgtgtggatctgacagggtataggaaaataaaaagcggagaaggtgtcttcag

SEQ ID NO: 3943 - DNA, 936 bp, Homo sapiens
atggacaatctcacaaaagtgacagaattcctgctgatggagttttctggtatctgggagctgcaggtgctgcacgccgggctgtttctgctgatttatctggcagtgctggtggggaacctgctcatcattgcagtcatcactctcgatcagcatcttcacacacccatgtacttcttcctgaagaacctctccgttttggatctgtgctacatctcagtcactgtgcctaaatccatccgtaactccctgactcgcagaagctccatctcttatcttggctgtgtggctcaagtctattttttctctgcctttgcatctgctgagctggccttccttactgtcatgtcttatgaccgctatgttgccatttgccaccccctccaatacagagccgtgatgacatcaggagggtgctatcagatggcagtcaccacctggctaagctgcttttcctacgcagccgtccacactggcaacatgtttcgggagcacgtttgcagatccagtgtgatccaccagttcttccgtgacatccctcatgtgttggccctggtttcctgtgaggttttctttgtagagtttttgaccctggccctgagctcatgcttggttctgggatgctttattctcatgatgatctcctatttccaaatcttctcaacggtgctcagaatcccttcaggacagagtcgagcaaaagccttctccacctgctccccccagctcattgtcatcatgctctttcttaccacagggctctttgctgccttaggaccaattgcaaaagctctgtccattcaggatttagtgattgctctgacatacacagttttgcctcccttcctcaatcccatcatatatagtcttaggaataaggagattaaaacagccatgtggagactctttgtgaagatatattttctgcaaaagtag

SEQ ID NO: 3944 - DNA, 3794 bp, Homo sapiens
gtccgcggcgccaccgctcgccctccaggttctgccacttgctgggaaaacagcaacagaaggatattaaggagccacccctataatttacccagatagccccagcaaggtcaaagacatatcatgtcccaaggagaaaagctgcaggcatctgaggataaatcactgtgaaacagctttgaccataaagctgacttggaagactttgactccaaggtgcaaggtggtttggacaccctcaatattgcctgctcttttctagtcaaacctgattcatgaaatggaatgaagctgaaaaatcatctacttctttgtttgtggatttgagagaagattgggatggtcttaagtgcataaaacgagactctaactgcagcgatgagttcagatgagaagggcatttcccctgctcataaaacatccactccaacccatagaagtgcctcctcttcaacatcctcccaaagggacagtaggcagagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcagcacctaactttactgacatgcaggctaactgtgtagatatttcaaagaaagacaagcgggtcacaagacgatggagaacaaaaagtgtcagcaaagatacaaaaatacaactgcaggttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggcactcaaccagaatgctgaactaaggagtcggttgaacagaatacattcagagtctattatttgtgatcaggttgtcagtgtaaatattattcctagccctgatgaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcaactgaaaacctaccatttgcttttctattcatctttataatggactttcagaagtgcattagacaaggcccctaaccactttgggatcctttctgttttgctgcaaccatattccttaaaaaaaaaaaaaaaaaaaaaaaaaaaatccacaccgtccttggaaagcagaataaaaggagcagaatataaaatccaaagtctgaccagtttgtaaagaaaaacaaatggtaactggtgcttaaagctgatcaagaaagttaacaacaacatagaaaccacacgattgttccactgtctggaagcaccatcccctatcgcaggactcctgggccacaagcagtcggtcagtgcagacttcaagtgtgtctgtttgatgtggtgtgattgtgctggccttgtcgaaaaagatgtgatgcttctcagaacctgttccatctgtatgccattgttcatgccttaagaaatgcaaagatgtacaataaatcatttttaaaaaaaaaaaaaaaaaaaaaaaa

SEQ ID NO: 3945 - DNA, 3548 bp, Homo sapiens
tttccacttgctgctcaggaggtattgagatcaatgaacactaacctgaggagcatatttttaccaaattaaagagctacagtgaaatatgtgttccaggttcctggttttaagctaaatatgcatcagttatctctgatcaggggaaacagagggcggagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcagcacctaactttactgacatgcaggctaactgtgtagatatttcaaagaaagacaagcgggtcacaagacgatggagaacaaaaagtgtcagcaaagatacaaaaatacaactgcaggaagggccacccgcgaagggccagttcagcacaactcggcgccggcagaggctagcggcagcagtggctacaacagttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggcactcaaccagaatgctgaactaaggagtcggttgaacagaatacattcagagtctattatttgtgatcaggttgtcagtgtaaatattattcctagccctgatgaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcaactgaaaacctaccatttgcttttctattcatctttataatggactttcagaagtgcattagacaaggcccctaaccactttgggatcctttctgttttgctgcaaccatattccttaaaaaaaaaaaaaaaaaaaaaaaaaaaatccacaccgtccttggaaagcagaataaaaggagcagaatataaaatccaaagtctgaccagtttgtaaagaaaaacaaatggtaactggtgcttaaagctgatcaagaaagttaacaacaacatagaaaccacacgattgttccactgtctggaagcaccatcccctatcgcaggactcctgggccacaagcagtcggtcagtgcagacttcaagtgtgtctgtttgatgtggtgtgattgtgctggccttgtcgaaaaagatgtgatgcttctcagaacctgttccatctgtatgccattgttcatgccttaagaaatgcaaagatgtacaataaatcatttttaaaaaaaaaaaaaaaaaaaaaaaa

SEQ ID NO: 3946 - DNA, 2550 bp, Homo sapiens
tcgtgccgcctttgcccgcttctgtggactgttcgaacgcccaggggtgggccaaacccgtttcttaggaaaccaggaatccagggaaggcagaatggcttcctttgggtggaagaggaaaattggtgagaaggtctcaaaggtcacttcccagcagtttgaagctgaagctgctgatgagaaggatgtagttgacaacgatgaagggaactggcttcatgccattaaacgtaggaaagaaattcttcttgaaggctgtgctgagaaaagtaaacagctgaaggatgaaggagccagtttggctgaaaataaaagatatcgggaggcaattcagaagtgggatgaagcactacagttaactccaaatgatgctaccctatacgagatgaaatcacaggtgctaatgtctcttcatgaaatgttcccagcagtacatgcagcagaaatggccgtccagcaaaatccacattcatgggagtcttggcagactttgggacgtgctcaacttggtttaggagagataatcctggcaattcgaagttttcaagtagcccttcacatctatccaatgaaccctgaaatatggaaagaagacctctcttgggcaagaacgctccaggagcagcagaaggtagcacagaggattaaaaaaagtgaagcaccagctgaagtaacacacttttcaccaaagtcaattccagactatgactttgaaagtgatgagattgttgctgtttgtgcagctattgctgagaaagagaagacagtttcagcaaataaaacaatggttattgtgtctgcttctggggccatagagactgtaactgaaaaggaggatggtgctacaccaccagatggctctgtttttatcaaagcccgatgaagcagtatgcataggattatttgaatctgtctttttgattgcctcttgaagttttgacatagagacatttactctggagatagataggagaactcctggttgtaaaatatgtttttcagatgaggcatataaaaactaaaatggcaggattattgtatagtgtttggaatatgctttgataagttatgatttatatttctcaaggttaaaattctgagtaaaatggtctttgattaataaacttagtttaatctgaatatgtaaatgaatacattttaaagacaaaacttgaaaaatgtattcttgaatagtgaataatttgatcaatgttactgaaatgctgtctcaacttttgttttatgataaaggaagtgtgtgatttccctccctctgagaaatatactgcgcttaatatttgctgtctttttcttgcttcattagagtaagtctgtcagaaagcttgaatatttttgacattcattttgattcaaagttgtcatttggttatatgtggaatctttgaaagtttggctgaaaatgcacacaaatgtgtacattctgaacattttctgaagtttctcttaattctgatttgtgtttctgttttgactttgaagttgtaacaatgatagttgtctccttcagtatttggtaaaagtgtaaagtattgataaatatgagaatgatggttttattttttaattgttacagtaagtaatccttaccacaaatgagctatttttaaaatatgcatttttaaatgaatggcttttacagataggttaatgacaattgtactgctatattatcccagtcaaaaccaatactttcttttctttattttacaaagctttaaaaaccctggaaacaacttacttcttgcttgtgtctttccatttgatgactgggaattacttttctagataactttttttgaaactactcagtgaaatgaaaaataattacaattttaaatagctaattatatctttctaaaaataaaaaagtagggctgttattagagtgccaatgaataaataacttaagcacaaaatacatagaaattggaatgtgatttatagtacaatctcatgagtatgaaaaggctatattaaaaaaaattttattgaaagtccacagtcatattcacaaaccaatactgtcattgctaatctgaactattatttttatactatatattgtagtacaataatatagaactgttgggttctgttacttctgacactcaggaagatactattggtgtattaattttatctttcttagagatgaaagtagcccgctttatgttaaagatcttactactgttggagcttataagtaatgatctacattttttatgaagatggtttttaaaacttttgttttattggaatgcatatctcttttcagggttggagaaattagcacttgccttgaaaagatattatttccttaagttatatcatcagaaaattagctctggttagagaggttagtttcagagtgctccaaaaaatatgttaattattttattttgtttaataaagaacattctcaaaacgtaaataggtatctagagaagtgagtactcaacatttggtatattgttttgagtaatggatgtttgttttttgtgtaatttgtgaataaatagtttttttctg

SEQ ID NO: 3947 - DNA, 3322 bp, Homo sapiens
gaaagctgtatttgctgcacgtggaaatctccgttattttccagcacccaacagtagcgtaatgggagtaacggacttaacctcatttctctttcagagcatttagccttcatatgcccttccctgcatgcttcccccaggccgtcaagacttgagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaaaaaaaaaaaaaaaaaa

SEQ ID NO: 3948 - DNA, 1394 bp, Homo sapiens
gacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatggaaatgaaactcttcatcaggtccagtgtcgtcctcttctgccacacagtccagctctagtgacgtagattccgatgcaacaccatgcaaaaccctgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaac

SEQ ID NO: 3949 - DNA, 4252 bp, Homo sapiens
aggctgggaagcggcgccatattggcgtcggccgcgctgtattgtcataaatagagccggttttgtggtgttttcactactcggttggatgcctcagccatagtaagtgggaaagtgagcgagcaagcgagctactagcgaccggaggaaagtgaacagggggagaagggaacagcaagaacaggactccagagcgataaacactcgctggagagggagacgcaggaagcgatgaaagagatgtctgcaaacaccgtgctggacagccagcgtcaacaaaagcattatggaattacctccccaattagtttggcatctcctaaagaaattgatcatatttacacacagaaattaattgacgccatgaaaccatttggagtgtttgaagatgaggaagaattgaaccacaggctggtggttcttggtaaattgaacaatttagtaaaagaatggatttctgatgtcagcgagagtaagaacctcccaccttctgttgtggctactgttggtggtaaaattttcacatttggatcctataggcttggagtacacaccaaaggagctgacattgatgcactttgtgtagctccaagacatgtggaaagatctgatttttttcagtctttttttgaaaaattgaaacatcaagatggcattagaaacttaagagctgtagaagatgcctttgtacctgttataaaatttgaatttgatggtattgaaattgatctagtctttgcaagactggcaatacaaaccatatcagataatttagatctaagagacgactctcgcctgagaagccttgatataaggtgtattcgcagcttaaatggttgtagagttactgatgaaattttgcatttagtgccaaataaagaaacttttagactcaccctaagagctgtcaaattatgggcaaaacgacgtggtatttattccaacatgctaggattccttggtggtgtctcctgggcaatgctagttgcaagaacttgccaattgtatccaaatgcagcagcatctactttagttcataagttctttttagttttttccaagtgggaatggccaaatcctgtgctgctgaagcaaccagaagaaagcaatttgaatttgcctgtctgggatcctcgggtaaatccatcagataggtatcatctcatgcccataatcacccctgcctacccacaacagaattctacgtataatgtgtccacatcaactcgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagacaacaattacgtatcaatgtggttccttgggataatttttcggagagtagaaaatgcagaaagtgtcaacatagacttgacatatgatatacagtcatttactgatacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaagtttattcgacttgaatcaacatttaaggacccccgcactgctgaagaaagaaaaagaaaatcagtggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacctttattgtctctccttagtctaattttttaaatatggattatgcttgaattactatatttaaaatgaaaatgtatagattacacagccaggaatgctagtatctaccaccttctttagatttcactcagcatttagtaggtccagtaggaaaaacccaaaatggtacattgagtagtgtggggaagacacctcgtgtattataggactcacgggatgccatctagcaagtggagaaatagcagtccattttctcttgcaagccctttaccattgagttgaaattcttgaattgccagagagccgtatcctccaggtcccactcctgttcattgccccttaggtctccaaaatgtaaattctaatgtttaccttgtaccatggaaaacatgaaaagagtcttagaagtaaagaacaacaaggaaaaaaatgtttgttctattattccctttttatatagcagcaaaagataagaataaaatcacataaccaagttgaaaaaaaaa

SEQ ID NO: 3950 - DNA, 4576 bp, Homo sapiens
gaattccgggcggcggcggccaaactccgcggcgtccccagggcgccacgttcgccctcgccgccgcggccgcgctgctcttcggctccgacatggaagatggaccttctaataatgcgagctgcttccgaaggctgaccgagtgcttcctgagccccaaagctaatggtatagatatagaagtcatccacagagatgttacagttgaagagatgggggtagagaagactttgaaggaaaagaatgtagaatgaggatagaagagaggaaatcccaacatttaacaggtttgacagatgaaaaagtgaaggcatatctttctcttcacccccaggtattagatgaatttgtatctgaaagtgttagtgcagagacagtagagaaatggctgaagaggaagaacaacaaatcagaagatgaatcagctcctaaggaagtcagcaggtaccaagatacgaatatgcagggagttgtatatgaactaaacagctatatagaacaacggttggacacaggaggagacaaccagctactcctctatgaactgagcagcatcattaaaatagccacaaaagccgatggatttgcactgtatttccttggagagtgcaataatagcctgtgtatattcacgccacctgggataaaggaaggaaaaccccgcctcatccctgctgggcccatcactcagggcaccaccgtctctgcttatgtggccaagtccaggaaaacactgctagtagaagacatccttggagatgaacgatttccaagaggtactggactggaatcagggactcgtatccagtctgttctttgcttaccaattgtcactgcaattggtgacttgattggtattctcgagctgtatcggcactggggcaaagaagccttctgtcttagtcaccaggaggttgcaacagcaaatcttgcctgggcttcagtagcaatacatcaggtgcaggtatgcagaggccttgccaaacagacagaattgaatgacttcctactcgacgtatcaaaaacatattttgataacatagttgcaatagattctctacttgaacacataatgatatatgcaaaaaacctggtgaatgccgatcgttgtgcgcttttccaggtggaccataagaacaaggagttatattcagacctttttgatattggagaggaaaaggaaggaaaacctgtcttcaagaagaccaaagagataagattttcaattgagaaaggaattgctggccaagtagcaagaacaggggaagtcctgaacattccagatgcctatgcagacccacgctttaacagagaagtagacttgtacacaggctacaccacgcggaacatcctgtgcatgcccatcgtcagccgaggcagcgtgataggtgtggtgcagatggtcaacaaaatcagtggcagtgccttctctaaaacagatgaaaacaacttcaaaatgtttgccgtcttttgtgctttagccttacactgtgctaatatgtatcatagaattcgccactcagagtgcatttaccgggtaacgatggaaaagctgtcctaccatagcatttgtacttcagaagagtggcaaggtctcatgcaattcacccttcccgtgcgtctctgcaaagaaattgaattattccactttgacattggtccttttgaaaacatgtggcctggaatttttgtctacatggttcatcggtcctgtgggacatcctgctttgagcttgaaaagttgtgtcgttttattatgtctgtgaagaagaactatcggcgggttccttatcacaactggaagcatgcggtcactgtagcacactgcatgtatgccatacttcagaacaatcacacgcttttcacagaccttgagcgcaaaggactgctgattgcgtgtctgtgtcatgacctggaccacaggggcttcagtaacagctacctgcagaagttcgaccaccctctggccgctctctactccacttccaccatggagcagcaccacttctcccagactgtgtccatccttcagttggaagggcacaatatcttctccactctgagctccagtgaatatgagcaggtgcttgagatcatccgcaaagccatcattgccacagaccttgctttatactttggaaacaggaagcagttggaagagatgtaccagaccggatcactaaaccttaataatcaatcacatagagaccgtgtaattggtttgatgatgactgcctgtgacctttgttctgtgacaaaactgtggcccgttacaaaattgacggcaaatgatatatatgcagaattctgggctgagggtgatgaaatgaagaaattgggaatacagcctattcctatgatggacagagacaagaaggatgaagtcccccaaggccagcttgggttctacaatgccgtggccattccctgctatacaacccttacccagatcctccctcccacggagcctcttctgaaagcatgcagggataatctcagtcagtgggagaaggtgattcgaggggaggagactgcaacctggatttcatccccatccgtggctcagaaggcagctgcatctgaagattgagcactggtcaccctgacacgctgtcccacctacagatcctcatcttgcttctttgacattcttttcctttttttggggggggtggggggaacctgcacctggtaactggggtgcaaacctcttcaagaaggtaacatcaaataaataagtcaagcagaggacttcctgccaatctcttctgtgaggcatcatagacactgagcaaccaggaccacccccacgttcagaaatcagctggccaagtgactccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaattttacacattactattgtgaatggtgaatgttcatgtatgacctacttgtaattaacttgagttgtagtccacagcctcaggacaaatgtcgttgaggttacagagtaagaaatgatggcaaaacgtcaaactcttatttcagagcttcatgaatttagttagactaaacataattctttaagttcaacctaaagggctgagatcaataaatttaacactagacgaagtagacttcctgtctttttgagaagagatgaggtatatgttacaataaatctcagaacttcaagtagcagttcaaaagatgtcagtttttaaaattgtttttgttgttgtcttggcagttttactgaaccctttgcataaagaacaaaataaaagctcggcattgtaatttttttaatggacaagtcttatggatacgaggggtacatttttcataatgattcctttatattttcactttgtgtcatatgcagaattttagactctcattcacaatgaaaagtttattttaaacattgtttaattaaaataccatacagttctcttttaaacatcaaaccataaaaagtgtattttgtaattttactctgacctgccgcagtcacctctcacttatctcttccacgtactgcacggtcgtatttcatgagctttctgtccatagcacagaaacagagcagaaagtagtacaatcatgttggaccttctttctgttctctttactcttctcacagatcagatcactccatagaagcctgtgggtttcgatggtttcttctatacacctttttggttgaccagtattactatacaatgtaagtgttttaaaaaatacgaaagtaatactctgcaccccttcctacaaagatgataaagcagtcacttctggcgcattttaataatttaaagatttttagtgcaatggcacggtaacctccaaacctgaattagacagagactcactcaggaagtgacaggcccatcatatcaaataacttattcacttttcatgtggcaggaaactggaatatcgcttttaataaaatggaaaaatatgcttctacatatttaccaccataggcgttttgttcatatgagcctggtttgtgcaaaattaaatcagaggcttctacaacatggtttatttatgttgtagcaaagttggctctacataaacattgttcttattttaaaattaacactatgtgttcagttttcttgtgggcttctgaaagttgccatcttccctccgtggagctccatttgctattttcattatacactatgaggtaaaatgtaataacaaaagagagagaagtaccactgtggctagatatatacacacacatatatatatggatggatgtaatatatgtagcacacacacatagatgtatataggatacacactcatgtatgtaaacgtatacatatgtgtatatatgatacatacacatacacacacacgagagacagaaggaaagagaggaagagagaagcaaacatgtaggaaaaaatataaatcagccggaattc

SEQ ID NO: 3951 - DNA, 2930 bp, Homo sapiens
agggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaaaaaaaaaaaaaaaaaaaa

SEQ ID NO: 3952 - DNA, 1599 bp, Homo sapiens
gtggtgcgccgcccgggcgaggatgcggctgttccggtggctgctgaagcagccggtgcccaagcagatcgagcgctactcgcgcttttcgccgtcgccgctctccatcaaacaattcctggacttcgggagagataatgcatgtgagaaaacttcatatatgtttctacgaaaggaacttcctgtgcggctggctaacacaatgagagaagttaatcttctgccggataatttacttaaccgcccttcagtgggattggttcagagttggtatatgcagagttttcttgaacttttagaatatgaaaataagagccctgaggatccacaggtcttggataactttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacacacttctgtttgggggtgacactaatcctgttcatcctaaacacataggaagtatcgatcccacctgtaacgtggcggatgtggtgaaagatgcatatgaaacagccaagatgctgtgtgaacagtattacctggtagctccagagctggaagttgaagaattcaatgccaaagcgccagacaaacctattcaggtggtttatgtgccctcacatctgtttcatatgctatttgagttgttcaagaactcaatgagagcgacagttgaactctatgaagacagaaaagagggctaccctgctgttaaaaccctcgttactttgggtaaagaagacttatccattaagatcagtgacctaggtggtggtgtcccacttcgaaaaatagatcgtctttttaactacatgtattctactgctcctaggcccagcctggagcctaccagagctgcccctttggctggatttggttatggtttgccaatttcccgtctgtatgctagatattttcaaggagatctgaaactgtattccatggaaggagtgggtactgatgctgtcatttatttgaaggctctttcaagtgagtcatttgagagacttccagtttttaataagtccgcatggcgccattacaagaccacgcctgaagccgatgattggagcaatcccagcagtgaacccagggatgcttcaaaatacaaagcaaaacagtaatataccaccttgatttccattacaaagtatctgatttgtctgaataaaggtgtcccactcactgttccaggaattcttgcagtgtagaggtattcacaacagcaagcagggatttggcctgccatcaattttatttaaaaagcaattaagtttgcagtttgtcctcataaacgttgtaggttgaaactgaaaaataagttaaaatgatcaatcaagataaaaggtgatctatccatccaatggaatattatttggccttaaaaaggaaggacatctgatatgtgctgcaacatgggtgaatcttgaagtcattatgctaagtgaaataaaccagacataaaaggacaaatacatcg

SEQ ID NO: 3953 - DNA, 3238 bp, Homo sapiens
catggcggccttagcaagctatagctgcgagatttgaattactccactcgtagctattgcattcctgacgatggcctctgtggcttcgtgcgattcgcgtccgagctcagacgagctccctggagacccctcttcacaagaagaagatgaggactatgattttgaagatcgggtcagcgactcgggttcatattcctcagcgagtagcgattatgatgatcttgagcctgaatggctggacagtgtgcagaaaaatggagagctgttttatttggaattgagtgaggatgaagaagaaagcctccttcctgagacaccaactgtgaaccatgtcaggttcagtgaaaatgagattatcattgaagatgactacaaagaaagaaaaaagtatgaacccaaactcaagcagtttaccaaaattttaagaaggaaaagacttttacccaagcgctgcaataaaaaaaatagcaatgacaatggaccagtatccattctaaagcatcagtccaatcagaagacaggagtcattgtccaacagcggtacaaagatgtgaatgtttatgtaaaccccaaaaagctaactgttatcaaagccaaagagcagctcaagcttctggaagtgctggttggaattattcatcagaccaagtggagctggagaagaaccggaaagcagggtgatggagagaggcttgtggttcatggcctgctgccagggggatctgctatgaagagcggtcaggtactcattggtgatgtccttgttgctgtgaatgatgtcgatgttactactgaaaacatcgagagagttctgtcttgcattcctggacctatgcaggtgaaactgacatttgaaaatgcatatgatgtgaaaagggagacatcccatccaagacagaaaaagacacagtccaacacaagtgatttagtcaagcttctctggggagaagaggttgaaggtatccagcagagtggcctaaacactcctcatatcattatgtatctcacactacagctcgactcagaaacctcaaaggaagagcaggaaattctttatcattatccaatgtctgaagcatctcagaaacttaaaagtgtgagagggatttttctcacactctgtgacatgctggaaaacgtaactgggacacaagttactagttcatccctccttttaaatggaaaacaaattcatgtggcttattggaaagaatctgacaagttgttgctaattggcctgcctgctgaagaagttcctcttcctcgtctaaggaacatgatagaaaatgtcatccaaaccttaaaatttatgtatggttctttagatagtgccttttgccagattgagaatgttcctcgtttggatcatttttttaacttgttctttcaaagagcacttcagcctgcgaaactgcattccagcgccagtcccagtgctcagcagtacgatgcttccagtgcagtacttttagacaacctccctggagtccggtggctcacacttccactggaaatcaagatggaattagacatggcattaagtgacttggaggctgcagattttgcagaactgtccgaggattactatgacatgaggcggctgtatacaattttggggtcttctctattttacaagggttatttgatatgcagtcatttgcccaaggatgatcttattgatattgccgtatactgtcgccactattgcctgctgcctttagcagcaaaacaaagaattggtcagttgatcatatggagagaagtgtttcctcagcatcacctccgacctttggcagactcaagcactgaagtctttccggaacctgaaggaagatattttttgctagttgttggcttgaaacattatatgctatgtgtactattagaagctggaggttgcgcatccaaagctattgggagtcctggaccagactgtgtatatgtggatcaagtcaaaacaactcttcaccagctggatggagtagattctcgcatagatgaacggctagcatcttctccagtcccctgtttgtcttgtgctgactggttccttactggatcacgtgaaaaaacagatagcttgaccacttcgcctattctcagtaggctacaaggtacttccaaagtagcaacttctccaacatgcagaagaacgctttttggtgactattccttaaagacacgcaagcctagtccttcctgtagtagtggaggatctgacaatggttgtgaaggtggagaagatgatggctttagcccccatactacaccggatgcagtacggaagcaaagagaatctcagggctctgatggtttagaagaaagtgggaccttgcttaaggtcactaaaaagaagtctactcttccaaatccatttcatttgggaaacttgaaaaaggaccttccagaaaaagaattagaaatatataacacagtgaaactgacatctggtcctgagaacacacttttccactacgttgccttagaaacagtgcaaggaatctttattactcctacccttgaagaggtggcacagctaagtggctctatccaccctcagctaataaagaatttccatcagtgttgtctttccattcgtgcagttttccaacagacattggtggaagagaaaaagaaaggactaaatagtggagaccattcagattctgcaaagtcagtgtcttctcttaaccctgttaaagaacatggtgtgttgtttgaatgttcacctggaaactggactgatcagaaaaaagcaccaccagttatggcttactgggtagtagggagactttttcttcatccaaaacctcaagaactttatgtctgttttcatgactcagtcacagaaattgccattgaaatagcttttaaattgttctttgggttaaccttgtagctgtgctttcttgatgcgtagaaacacgtgcatggaggatcaaacactgtcagaattgctgaaatcaatacacaaagagataaagtttagcttctttttactattcaatattgaacataatattgttaaatattgagatgaaatgctgttggatttgatacattaaatcttaatgtaatattgtaagacttttgagaatatacttgattaaaatgtgaaagaagggattgttaacttattgctattttggtatataatgttaatttattgactagtttgaaataatgtgaagtgttttttatatcagattaatataggaaatgtttattcttgaaaaat

SEQ ID NO: 3954 - DNA, 1239 bp, Homo sapiens
cggcgagggtcctgccgagggacccgttctgcgcccaggcaggctcgaagcacgcgtccctctctcctcgcagtccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaatatttttcccactagtggccccaggccccagcaagcctccctccatcctccagtgggaaactgttgatggtgttttattgtcatgtgttgcttgccttgtatagttgacttcattgtctggataactatacaacctgaaaactgtcatttcaggttctgtgctctttttggagtctttaagctcagtattagtctattgcagctatctcgttttcatgctaaaatagtttttgttatcttgtctcttatttttgacaaacatcaataaatgcttacttgtatatagagataataaacctattaccccaagtgcaaaaaaaaaaaaaaaaaaaaaaaaaaaaaaaaaaaaaaaaaaaaaa

SEQ ID NO: 3955 - DNA, 605 bp, Homo sapiens
attactactgaaggaagaacgtgagtaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctggcaaaaaaaaaaa

SEQ ID NO: 3956 - DNA, 2150 bp, Homo sapiens
gtatgcattattcatcactgttctaatcaaacaatcaaaatcgtttactttcaccgggaatatttagcaagatcaaagacactctggctggaacggctcttgttttaccgctgacagatagcctttgatttttattttttgcagtgttccagtgttttctctcaaaactctgtgtttggaacatcaaggatggattatcccaaaatggattattttctggatgtagagtctgctcacagactcttggatgttgagtcagctcaaagattcttctacagtcaaggagctcaagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcagctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagctctgagcagcgggtcccctgttccacttcttaccacagctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattatacaccagctccctggccatgaaggtctgcaggaaggactccttagccatcaaactcagcaacaggccctccaagcgagagctggaagaaaagaacatccttcccaggcagacggatgaggagcggctggagctgaggcaacagattggcaccaagctcaccaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaaggtttcaccgaccttaacagtcgaattcctcttgagtgctatgctgtcttcaaaacataaatttataagaaccataagtgctggtatttattcacttccccattacgatgtaaatcttctgaactgccttttttttaaaaagaagaaaaatcaaggaaacacaatcaggattttatgtgtgaaaacgcaaaagtgatggctcggcggtccgagctgctggtcccacttctgacac

SEQ ID NO: 3957 - DNA, 1897 bp, Homo sapiens
gcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtgtgtacatcccgattctggtttaattatcgacatgttgcaaataccctttctgtttatagaagtgtcaagaggctaggtattcctgacagtcacattgtcctaatgcttgcagatgatatggcctgtaatcctagaaatcccaaaccagctacagtgtttagtcacaagaatatggaactaaatgtgtatggagatgatgtggaagtggattatagaagttatgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagacttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaaaaaaaaaaaa

SEQ ID NO: 3958 - DNA, 5663 bp, Homo sapiens
attacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaaaaaaaaaaaaaaaaaa

SEQ ID NO: 3959 - DNA, 6453 bp, Homo sapiens
tacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaaaaaaaaaaaaaaaaaa

SEQ ID NO: 3960 - DNA, 5823 bp, Homo sapiens
agcgaaatccagttggcttctcaatgaggagccggcagtgagcggcggtggcccggacgcactgccgggcggggcgtggggcggagggacgagccgagccgagccaagcggagctgggccactgtgcacgcccggagggtcctggcggcgcccccgctcctgcgcgcactctcggcgccggacacgagcactgcctgccgggaacaggctggggggaggtgcgggggcttggcccacttggtggaagaacagctttggggattttttttttttcattgtcggatacaggcatttcaaagggaaaccgttgaaatgcataacctgcaaacactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaaaaaaaaaaaaaaaaaa

SEQ ID NO: 3961 - DNA, 6502 bp, Homo sapiens
atgtgcccagtagattttcatgggatcttccagttagatgaaagacggagagatgcagtgattgcattgggcatttttctgattgaatctgatcttcagcacaaagattgtgtggttccttaccttcttcgacttctcaaaggtcttccaaaagtgtattgggtagaagaaagcacagctcggaaaggcagaggtgccctcccggttgcagagagcttcagcttctgcttggtaactctgctgtctgatgtggcctatagggatccttcacttagggatgagattttagaggtgcttttgcaggttttgcatgtcctcttggggatgtgccaggccttggagattcaagacaaagaatacctttgcaagtatgctatcccatgcctgataggaatctcgcgagcatttgggcgttacagcaacatggaagagtctctcctctcaaagctctttcccaaaatccctcctcattccctccgtgtcctggaagagcttgaaggtgttcgaaggcgttcctttaatgacttccgctccatcctccccagcaatctgctgactgtctgtcaggagggtaccctgaagaggaaaaccagcagtgtgtccagcatctctcaggtcagccctgaacgcggcatgccccctcccagttcccctggaggatctgcctttcactactttgaagcctcctgtttgcccgatgggactgccctagagcctgagtactacttttcaaccatcagctccagcttctcagtctctccccttttcaacggtgtcacatataaggagtttaacattccattggaaatgcttcgggaactcttaaacctggtgaagaagatcgttgaggaggctgttctcaaatctttggatgccattgtagccagtgtgatggaggccaaccccagtgctgatctttactacacttccttcagtgaccctctctacctgaccatgttcaagatgctgcgtgacactctgtactacatgaaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgagtgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattttgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacagggctggccatggccactgagagcatccttcactttgctggctacaacaagcagaacacaactcttggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccaccctggccttccagcaggcccgctacaacttcatccgaagcatggccgcctacagcctcctgctgttcctgctgcagatcaaggacagacacaacggcaacattatgctggacaagaagggccatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtggcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtaaaaacccaaaaaaaaaaaaaaa

SEQ ID NO: 3962 - DNA, 4475 bp, Homo sapiens
tccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcagtaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcaggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaaaaaaaaaaaaaaa

SEQ ID NO: 3963 - DNA, 4604 bp, Homo sapiens
tccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcagtaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcagtcggcagcacctcttcctcaccagcactgttaggaatcagagaccctcgctctgaatacgataggacccagccacctatgcagtattacaatagccaaggggatgccacacataaaggcctgtaccctggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaaaaaaaaaaaaaaa

SEQ ID NO: 3964 - DNA, 2875 bp, Homo sapiens
gaattctccggagctgaaaaaggatcctgactgaaagctagaggcattgaggagcctgaagattctcaggttttaaagacgctagagtgccaaagaagactttgaagtgtgaaaacatttcctgtaattgaaaccaaaatgtcatttatagatccttaccagcacattatagtggagcaccagtattcccacaagtttacggtagtggtgttacgtgccaccaaagtgacaaagggggcctttggtgacatgcttgatactccagatccctatgtggaactttttatctctacaacccctgacagcaggaagagaacaagacatttcaataatgacataaaccctgtgtggaatgagacctttgaatttattttggatcctaatcaggaaaatgttttggagattacgttaatggatgccaattatgtcatggatgaaactctagggacagcaacatttactgtatcttctatgaaggtgggagaaaagaaagaagttccttttattttcaaccaagtcactgaaatggttctagaaatgtctcttgaagtttgctcatgcccagacctacgatttagtatggctctgtgtgatcaggagaagactttcagacaacagagaaaagaacacataagggagagcatgaagaaactcttgggtccaaagaatagtgaaggattgcattctgcacgtgatgtgcctgtggtagccatattgggttcaggtgggggtttccgagccatggtgggattctctggtgtgatgaaggcattatacgaatcaggaattctggattgtgctacctacgttgctggtctttctggctccacctggtatatgtcaaccttgtattctcaccctgattttccagagaaagggccagaggagattaatgaagaactaatgaaaaatgttagccacaatccccttttacttctcacaccacagaaagttaaaagatatgttgagtctttatggaagaagaaaagctctggacaacctgtcacctttactgacatctttgggatgttaataggagaaacactaattcataatagaatgaatactactctgagcagtttgaaggaaaaagttaatactgcacaatgccctttacctcttttcacctgtcttcatgtcaaacctgacgtttcagagctgatgtttgcagattgggttgaatttagtccatacgaaattggcatggctaaatatggtacttttatggctcccgacttatttggaagcaaattttttatgggaacagtcgttaagaagtatgaagaaaaccccttgcatttcttaatgggtgtctggggcagtgccttttccatattgttcaacagagttttgggcgtttctggttcacaaagcagaggctccacaatggaggaagaattagaaaatattaccacaaagcatattgtgagtaatgatagctcggacagtgatgatgaatcacacgaacccaaaggcactgaaaatgaagatgctggaagtgactatcaaagtgataatcaagcaagttggattcatcgtatgataatggccttggtgagtgattcagctttattcaataccagagaaggacgtgctgggaaggtacacaacttcatgctgggcttgaatctcaatacatcttatccactgtctcctttgagtgactttgccacacaggactcctttgatgatgatgaactggatgcagctgtagcagatcctgatgaatttgagcgaatatatgagcctctggatgtcaaaagtaaaaagattcatgtagtggacagtgggctcacatttaacctgccgtatcccttgatactgagacctcagagaggggttgatctcataatctcctttgacttttctgcaaggccaagtgactctagtcctccgttcaaggaacttctacttgcagaaaagtgggctaaaatgaacaagctcccctttccaaagattgatccttatgtgtttgatcgggaagggctgaaggagtgctatgtctttaaacccaagaatcctgatatggagaaagattgcccaaccatcatccactttgttctggccaacatcaacttcagaaagtacaaggctccaggtgttccaagggaaactgaggaagagaaagaaatcgctgactttgatatttttgatgacccagaatcaccattttcaaccttcaattttcaatatccaaatcaagcattcaaaagactacatgatcttatgcacttcaatactctgaacaacattgatgtgataaaagaagccatggttgaaagcattgaatatagaagacagaatccatctcgttgctctgtttcccttagtaatgttgaggcaagaagatttttcaacaaggagtttctaagtaaacccaaagcatagttcatgtactggaaatggcagcagtttctgatgctgaggcagtttgcaatcccatgacaactggatttaaaagtacagtacagatagtcgtactgatcatgagagactggctgatactcaaagttgcagttacttagctgcatgagaataatactattataagttaggtgacaaatgatgttgattatgtaaggatatacttagctacattttcagtcagtatgaacttcctgatacaaatgtagggatatatactgtatttttaaacatttctcaccaactttcttatgtgtgttctttttaaaaattttttttcttttaaaatatttaacagttcaatctcaataagacctcgcattatgtatgaatgttattcactgactagatttattcataccatgagacaacactatttttatttatatatgcatatatatacatacatgaaataaatacatcaatataaaaataaaaaaaaacggaattc

SEQ ID NO: 3965 - DNA, 4565 bp, Homo sapiens
gaattccgggcagcatcatcaaggcacatagattctctctttgaacaatgcagctgctgcaggggatggggaagggatggcactggcaattcaagactgcctttcctacttcttcagtgcctctttcaccaatatgaagttaaaaccaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttacaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctcaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtgtgtgtgtggcagagagagagaaagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatacatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggctactctgaaacacactgaaagctctgttgcaattaggatttgatgtgacataatattgttgtataatttcgagatttgtaggaaggtctcattcttccaagctgagagtctagcactcattttctataacagatatggcagcttagaggtgttggctttgtttggatgtaattttaggggtactaaaatttaaaatttaaagataattgttcaacaatatcatatcatcacattgagctgatataaattctgtgggtccgataatatctttgtgataatttaagagctaaccagttaccacacatctatgatataaccctaacacacacagaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctat

SEQ ID NO: 3966 - DNA, 2087 bp, Homo sapiens
gttttttaggaagagtgtcccgcagagacccggcgggagctgccaggagctctgggattccagcggctggaagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttctcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaaatggagtttcgctctcgttgccgaggctggagtgtagtagtgtgatcctggctcactgcaacctccacctcccgggttccagcaaattctcctgcctcagcctcccaagtagctgggattgcaggcgcccgccaccacgcccggataatttttgtgtgtttagcagagacggggtttcaccatgttggccaggctggtctcgatctcctgacctcaggtgatccacccgcctcggcctcccaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccaaattcatacagatcgtttaaataaatgaacatcattaaagtc

SEQ ID NO: 3967 - DNA, 5494 bp, Homo sapiens
cccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgtataccaaaatccatttcctttgtaacaagaatttaccagtaactgtgatctaggttgccaaaagttgtctgaatctccttattcttctctgatcttcatttatgcagccaatgtctagctggacctgccctcatcttgcagttcatacaggcactgtttgagagattgtttattattagatgttgtaatgctgcttcaagattcttcatggttacatgggatgcccctgctcatctggtcctgaagtagtaacattcacccaaatgaggatatagtcattattccttttcagtcactgtacgaacacggcagactttagcctacacagtagactgtgttaggcacttctggtaacattgacactgtatcttgacaccactaagcaacaggaaggaataaattccaatattgagacagagatttatttcattttgctcccaaaggcactgacaacatgagtccttgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttagtaagtatgagtctaaccttgtttgacattcaggtcttctgctacattatcttctttgagaaaaattaattgattataaaatatgtgctacttcacttacattattaaatatgtattaacgcctctcaccagggcttccagtgaagttacaatgccctagtctgtgaattagtctggaaacgtgtttttccttttcggatgttagagtaccctttgataaactaaattttactaagctgaacaactctgacagtctaaagagctaatgtgggttaccaaaaggcctgtacctgtaaaacaaaatgcaggtgtaatgattatacatgtatatggattacctggacatactctcatttgggttgttcttcaaagaagcaagcagccgatccctgttttcataaagctaatacttcagttggaaaaattaaacaggagcacaaagtcagggataggggttagcagaagagagaaatagtgtcacatcaagggcaggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaaaaagcctgaaaggaccctttcccttataagtaatttaatccaatttctccccattttatagatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcaggcaagatacctctaagctgttttgaaccctctgatattttgtatttatgtgtttgtctgtctccccctactagaatgtaagctccatggggcagggacttcactgtattttgttcatagtgtatccccagagcctggaccagtgcttggcacataggagatggcaataaatgcttgtagaattaataaacaaaaaaaaaaaaaaaaa

SEQ ID NO: 3968 - DNA, 3089 bp, Homo sapiens
aaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataat

SEQ ID NO: 3969 - DNA, 6140 bp, Homo sapiens
gcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaataccaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgttcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaactccttgtctctcaacgtattggctatgacgcagcaagcagaatgaatttggactcagttacaggctgtcaatggtctgctctgtagcagtctcagagcctccccgacccactacctggagatagccagatagccagatgccctgctcctggccacctttaaagcccctgcatatgacacaggttaactaaagtcaagattggggctgctgcattccaggttccctagactcacaagctggtccttggccaggtgcagtggctcacgcctgtaatcccagcactttgggaggctgaggcaggcggatcacctgaagtcagaagtttgagaccagcctggccaacataattaaaatgtctctactaaaaatacaaaaaattagctgggtgtggtgacgcttgcctgtatcccagctactcaggaagctgagacacgagaatcacttgaacctgggaggcagaggttgcagtgagctcagatagtgccactgcactccagcctgggtgacagagcgagactccgtctcaaaaaaaaaaaaagaaagcagaacctcatggctatagagttggcattttagccccagcttctgtagctctgaaagcctaaagaaggtattctctccatctgttaaacacagtatagtggctctcagcccttggggcatgttatcatgggagggaagtcaaataagaggagagaaaagaactcaagggggaaactgcatttttaggctttgctctcttaccttgccctttctactcagaaccaataacttctgcatcaaaacatgttacagcctgcatcaagggctttaccccaacctgcagcccagccttccctgggtgagcttgctatgcgcagccacatttaccatgtggggctccctattctgatggcctgttcggtgccgggtttactcactgccctgttctgatgtcagtgcctgtacatacctccaaaggcaggacttgcctgataaatatttttcctcctctgaactggattttataggcattaaagacaagtcgggtggctagagggctccttgagacatacctagcagggaactgcaggtggattctgttgagaggcaaagcacctgagtggttgggacacaggcagctggcatgggagggactttttttgagacagggtctcactgtgtcgcccagggcaaggatgcccaaagacaccaggttggagaggcacctgccaactacttgctttccctggagcctgcatgtgcctgtggggtggggaggcgtaggggtctacggctgcctgagatgggtgtgcacagtgtgtgaagtacctacctccttgccttgctggactgtcagccagtcgcagggccggccacaagacccatgtctccatctggtcatactccatagctaccaagttaacctgctctaaactttggagaactggatctgtccaataaacgcttatttggccaagcctgatggctcgtgcctgtactcccagcactttgggaggctgaggtgggagggttgcttgagcccaggggtttgagaccagcttgggcaacaacaacaaaaatgccaggtgtggtggggtgcacctgtagtcccagctactagggaggctgagccaggaggatcacttgagcccgggaggttgaggctgcagtggggggtcataatcatgccactgtactccagcctgggtgacagagtgagaccctgtctccgaaaaaaaaaaaaaaaaaagaacggaaaaagaaatgcttacattgtcagggatcctgtagacaatcattaactctatgagatgcttggttctatttttttgggagactttgtccaagtgttttggcttaagaaatccataggcctctcttggtgacacatctctagtactttttgtcataaacaaacaggccatctgccgccaaatacatccactccccatgccactgacatcctatgggtcagccaggcttgctttgactgaggccgaggcatctggaactttctctgcctgcaggggctagcagcagaggcttcaccgcatcaccaccccttcctccactcctgacattctttcccttcagggatccaaaatggttggccgagctcccagtgggaaaacgtgtgctagagttggggagtgagatgagtggtgctgtccatggaatcaggccacagcaggaactgccccactggccatttgagacacacacaggtggtaaatgctctgctggtgggctgtgcttccctcattcagagagctctgttacagcccactgtgtcctttagaagcttgaaaggaacccaactctttgctgcactgtcctttttcttcctcaaattcagaccctccttccaccggcacccccctactccaccctcagctcttccttgcctggtttatcaagcagagctgaggccccacgtttccaactctgattgtcacttgcatcttcacaaaggataaaccacggagcaactggaaaaccatcagccaagcgttcggatgagtctggttattggtccacccccgaccagattcccttacacttaactcacttctttctttggcaatgaccctcatgacatgtataaatgggtatgactaagaagaggctgtgatctaacatttatttgctgccattttttactctggggagaagcagccccaactcatcactgggaaagaactccccctgcaaaccagctaaatttgataatttaaaccccctgcccctaaaacttctcacagagctggggagttggtggcaactttccaagtcaaggtcttgcttagaaagtccttcactacatggccaggtgcagtggctcacgcctgtagtcccaggtacttgggagcctgaggcaggaggattgcttgagctcaggagttcaaggctgcagagagctatgatcatcccactgcatttgtttaaaaataaatttttaaaatttgtgtgttttatcaggggtctcctgtacagtgtatctgtgtatgtttgtgtgtgtgtttgtatacagccttgtttaatgttttgagcaataagatatgcacacacaggtattttgttgctaaagagattggacaaggttgtagctgtgctcaggcttcagcttggtttgttaaattgagagataaacaatgacaagagctgccagccaaccacactattcaaaaagcaaagtgttcaccactaaagctaaccattcatctggttgcaggcaaggctaaggctctctctcctctagttcctggaacagactcacagattggcatgaagcactgatcaggggctgcactcagactccctggccaagcaaacctacaccagaagagtcagtgtcacagatatgatgcggccaatctctgtctccaaaaacctacctgaacttaatggtagaattcaaagatctggggactgagggcacccagccttctaaaacacaatgtattcatgtgtttagtgtaaactctctgcatggattctcagtgttaataataaaaggaagcattcttttacaactcctgctgtgtgcaaaagaaagtgcaaaggatttggagtggcattccgaagatcaccacacataccttggttctgatggctgctgaactccgacttcttcgctgagacatgactgtgggaacagcctccagctatctgctcatcagaggtgctttcctcaacctcctgcaccacctccaagagaaacagcctaaaaagaaaccccagctgtttacttatattggtctgtaaatccctggaagtaaaccccatgcatttttatctactgtctgaggacatacaataaatctgagaaagtctatgctgtcaaaaaaaaaaaaaaaaaaaa

SEQ ID NO: 3970 - DNA, 2302 bp, Homo sapiens
gttcctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgtggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagcagcatagggcattcggtggccagagccgagggtcctcccacacgtgctcacccacccgcagcctaggcaggctctgcatgctatgccaggcatgtgccgtctggacttccacctccagtgccagaaacttccagaaagaaggagaaactcttgtcaagaatggcccagaggaatgcctcgcacaaaaggtcttccccacccacccccagccccctagtctaatacccaccctgatacgtgcaatcatgtagttttggcggaaatttccccatcattctaggatgatacagaaagaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctgctgcttctctgtctccgagaccggagtacttgggaacaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccgcggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtttaaaaaaaaaaaaaaaaa

SEQ ID NO: 3971 - DNA, 4881 bp, Homo sapiens
gccgcctcctagcggcccgggccgcgaccacgctgcccgccccgccccgagcccggggccccgcgctccgctgcagtgaagggcgttgcatttcccggggtaccccgagctgccctcttgtgactccttggcggggcggctggtcagacaaagtgtgcctccgggccggagggcgacccagaggagggggaagatgccgccggccacgggcggaggcctggcagagtccgagctgcgtccccggaggggccgctgtggcccccaggctgctagggccgcaggccgggacgtggccgctgaggctgtggcgcgaagccccaaacggcctgcttggggctcacggcgcttcgaggcggtcggctggtgggccctgctggccttggtgacgctgctgtccttcgccacccgcttccaccgcttggacgagccgccgcacatctgttgggatgagactcactttggaaaaatgggaagttactatatcaaccgtacatttttctttgatgtgcacccgcccctgggaaagatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaaacttcccggaacttgcacagtcactatcatgaggcccccatgacccggaagcactatcaggtcaccggctatggcataaatggaacaggggactcaaatgatttctggcggattgaggtcgtaaacaggaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcagggttgtcccaggtcctgcttcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcaatgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccgtgggcaattccctttctctctgtcactgcttcagcagtgaagacccatggcacctagaaatgcatgccagcttcctgcgtctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcctctgaagctcccaacaactctgacagggtcagatctctttaaagcatcttcaggaggcggttgccacggagactggatattggtcccagggacaggctgtgctacctactgggtggtggggagggaagcttctggccatgcttgggcattcagaccaaccatcattaatgttaatagaggaaatgcagcaacgtcaaaagcaaggcaggttggttaattagatctggggcccgatgacctccctttcccactgctacagcccttttgacttcccccagcaggaagcgctgtctgtgcggctgagtctgggccacttgcttaattgcatttctggcagggaaggagaggagggatggagaagctctgctcgctgcttccacctcaccgtgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagccaccttgcatgagggtgaggaaggagaagcccagccagcctctacccatccctccctcccaattaggctgcactggggccgaacgcttccctgggctcccactgccttctaaggagccaaggagaattccctgcccactttctgttcctccatgcccaaactggcagatgcttctctgggagcaaggccacatgggctgatgcagctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaaaaaaaaaaaaaaaaa

SEQ ID NO: 3972 - DNA, 1638 bp, Homo sapiens
tcagcgggaggggctggaccccgcgttcctcctccctgccggtccccatccttaaagcgagagtctggacgccccgcctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaaaaaaaaaaaaaaaaa

SEQ ID NO: 3973 - DNA, 1641 bp, Homo sapiens
tcagcgggaggggctggaccccgcgttcctcctccctgccggtccccatccttaaagcgagagtctggacgccccgcctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggcttccatgcctatggctgttctaaaattgggccaaatatatccatttcagagaggctttttctgtaaagacaacagcatcaactatccgtaccatgacagtaccgtcacatccactgtcctcatcctagtgggggttggcttgcccatttcctctattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaaaaaaaaaaaaaaaaa

SEQ ID NO: 3974 - DNA, 1841 bp, Homo sapiens
agctgggaccggagggtgagcccggcagaggcagagacacacgcggagaggaggagaggctgagggagggaggtggagaaggacgggagaggcagagagaggagacacgcagagacactcaggaggggagagacaccgagacgcagagacactcaggaggggagagacaccgagacgcagagacacccaggccggggagcgcgagggagcgaggcacagacctggctcagcgagcgcggggggcgagccccgagtcccgagagcctgggggcgcgcccagcccgggcgccgaccctcctcccgctcccgcgccctcccctcggcgggcacggtatttttatccgtgcgcgaacagccctcctcctcctctcgccgcacagcccgccgcctgcgcgggggagcccagcacagaccgccgccgggaccccgagtcgcgcaccccagccccaccgcccaccccgcgcgccatggaccccaaggaccgcaagaagatccagttctcggtgcccgcgccccctagccagctcgacccccgccaggtggagatgatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataa

SEQ ID NO: 3975 - DNA, 1529 bp, Homo sapiens
attcacttctcacaaggactgggtgaagagttctgcagccttacagagactggaaaagaagcccaaaccaaggcccccagagaggtcccccaggcccctttgggtccctgagcctcagctggaggtggggggtgcctgcagtgcgctggctcagtctccttctgaaaagctggatccagcttgtttgaagcccttgagctgatcttagatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataacaaaaaaaaaaaaaaaaaaaaaaaaaaa

SEQ ID NO: 3976 - DNA, 2850 bp, Homo sapiens
tcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggtctgcagggaactggccaggcaagggggcaggcccgtttctcctggtggttggtgcgttgtagcagcagcgggagccaggactaaggacaagcaggagctgggagccccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgctggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgaccggaaacatcaaaatccaccccttcttcaagaccataaactggactctgctggaaaagcggaggttggagccacctttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaaaaggagcacaagctgtttgaaccaccaggtttatttgtgtgtctaaataaacaccaaatagtaccaaaaaaaaaaaaaaaaa

SEQ ID NO: 3977 - DNA, 2738 bp, Homo sapiens
tcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgctggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgaccggaaacatcaaaatccaccccttcttcaagaccataaactggactctgctggaaaagcggaggttggagccacctttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaaaaggagcacaagctgtttgaaccaccaggtttatttgtgtgtctaaataaacaccaaatagtaccaaaaaaaaaaaaaaaaa

SEQ ID NO: 3978 - DNA, 5907 bp, Homo sapiens
aaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctctggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttctttgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatataaatataaatatatgtttgtttgtttttttaaggaaaaacaagtcaagctagcatccagttactatatagcttggctaaattatacaagacttacaagattgattactcgacaggcttgtatttaagagataactgtgaggttaccattatgtgatgttactataaggacttttaacattggtttaacaaaccatagaggcattgaagggtttttcttagatgcctagaaaaagcgcactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagcagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagaaaactgaggcaaggggagattaacttactgccaaatttcaaacagttagtagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcagagaatctggagttgaatgattattccagatactgtataacctgcataactttttgtctttaagtcgtgtttgtaaaagaagtaattgctagaaacatttgataatgtacaaagtagtctataatgactgttcagtacatttttaatatttttttggttatatccaactttttgtaaatatactggaagcttgataataaaatgtatttcctatcaccatacttttccatgtgaaaacctgagcctatttctagtataagtatccaaagaaaagtttgacctggttgtgttattttaccagaccttggtaaaagaactattttggaaacagtatttgtaaatggaactaatgctatatttaaaaacactgatttttttttaacctgccaaaaataaaaaaaagctcattttataattttctactaaaaaaa

SEQ ID NO: 3979 - DNA, 1250 bp, Homo sapiens
actaatttagaaaacgttgctttcgcagacttcgccgggtgcctttcactgccaaactaaatactccactttaaaatacgcccctgcgtactcatgtgatttctccttttaggctaggaatgtaatgttgacataaatgtcaaataaaattaatgagagaatgggccctcaaatggtgctcctgtgaagggaatttgttagactgggacctttgagcccaaatgtatatataattatataacactcagacaaggaaggaatctgaatgttaagctttagcaaatgtatcacctttgtcagaaatgctgttacctacaaaaaaaaaaaaacccaaaacaaaacaaaacaggttgcaagtaaattaagatgaaaataccatcagattagaagtctgtcacggcaagctactgcagaattagaagggtggcccatctgctgggtatccaatccttcccttatctgtatagaattcggatcagatgtcttctgttccccgaacacttccgctgttgactttgcaaatggacctcctcccgcccaacccagctccttccctccctcctccgtctctcccaactggccacttaggaagagtaaaaatggcaattagaacaggagcagctattttcactcagtagtcaaagaattggatactagcacagtggctgcctccatccgtatgctgatacataactactttgtcttgtatttgtagtctcaaaaatcttccctaagtatagtagaatcagagaaaatcgctctaatcattgaaaagcgccctgtgctgagtaaagcagccagtcttctcttgtcaccgtaaaaggctgggagtaaaatttcccataaacacaggggaaacctacatttactcacatgccaaggaaaatggcacggaagacccacgtgtagccacagcagagtctatgcagagggcctgcaaatgcctggggtgcgagtgaatgcctggaggggcggagtttccaagataacagctattgtgttttctttttcacacttcagaagagaatcctaaggactagactccgctcagtgcattcctttttcatacactgatctcaagtacaatcacataattttgaaaatccatgtagtcctccataaataaaattataaggataggtttctatttccttccgattacctagatacctccgtcttctggaaaaccccaaaaagaccagtagacgaatcaggaaggtcctaggagtgattcctccaatggcaggaat

SEQ ID NO: 3980 - DNA, 1250 bp, Homo sapiens
actaatttagaaaacgttgctttcgcagacttcgccgggtgcctttcactgccaaactaaatactccactttaaaatacgcccctgcgtactcatgtgatttctccttttaggctaggaatgtaatgttgacataaatgtcaaataaaattaatgagagaatgggccctcaaatggtgctcctgtgaagggaatttgttagactgggacctttgagcccaaatgtatatataattatataacactcagacaaggaaggaatctgaatgttaagctttagcaaatgtatcacctttgtcagaaatgctgttacctacaaaaaaaaaaaaacccaaaacaaaacaaaacaggttgcaagtaaattaagatgaaaataccatcagattagaagtctgtcacggcaagctactgcagaattagaagggtggcccatctgctgggtatccaatccttcccttatctgtatagaattcggatcagatgtcttctgttccccgaacacttccgctgttgactttgcaaatggacctcctcccgcccaacccagctccttccctccctcctccgtctctcccaactggccacttaggaagagtaaaaatggcaattagaacaggagcagctattttcactcagtagtcaaagaattggatactagcacagtggctgcctccatccgtatgctgatacataactactttgtcttgtatttgtagtctcaaaaatcttccctaagtatagtagaatcagagaaaatcgctctaatcattgaaaagcgccctgtgctgagtaaagcagccagtcttctcttgtcacagtaaaaggctgggagtaaaatttcccataaacacaggggaaacctacatttactcacatgccaaggaaaatggcacggaagacccacgtgtagccacagcagagtctatgcagagggcctgcaaatgcctggggtgcgagtgaatgcctggaggggcggagtttccaagataacagctattgtgttttctttttcacacttcagaagagaatcctaaggactagactccgctcagtgcattcctttttcatacactgatctcaagtacaatcacataattttgaaaatccatgtagtcctccctaaataaaattataaggataggtttctatttccttccgattacctagatacctccgtcttctggaaaaccccaaaaagaccagtagacgaatcaggaaggtcctaggagtgattcctccaatggcaggaat

SEQ ID NO: 3981 - DNA, 1677 bp, Homo sapiens
ctccgcggccccctcccccggccccgggctccggctccggctccggctctggctctgcgcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 3982 - DNA, 1560 bp, Homo sapiens
ctccgcggccccctcccccggccccgggctccggctccggctccggctctggctctgcgcggtggcagcggcggcggcggcgcggggaccgagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 3983 - DNA, 1900 bp, Homo sapiens
caggaaggggtgctctgtgggcttggaggatgcaggcgccttcctggggactgctctgtgagcagtgataaaatatttatcagccagcagctgggcttccctgcatagggtgcagtcgggggcagctcccacccgagcctgcagcctgagttctgctgagtcatgggggagcccagtgagccgcctgccctcaagctcctgggccccctctgccctttggccatgtgaacgcctcctaatgtgtaagccattcggctgcccccaaggccaggcatccagtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 3984 - DNA, 2017 bp, Homo sapiens
caggaaggggtgctctgtgggcttggaggatgcaggcgccttcctggggactgctctgtgagcagtgataaaatatttatcagccagcagctgggcttccctgcatagggtgcagtcgggggcagctcccacccgagcctgcagcctgagttctgctgagtcatgggggagcccagtgagccgcctgccctcaagctcctgggccccctctgccctttggccatgtgaacgcctcctaatgtgtaagccattcggctgcccccaaggccaggcatccagtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 3985 - DNA, 1873 bp, Homo sapiens
cggcctccgtttgcgccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 3986 - DNA, 1709 bp, Homo sapiens
attttgaatgtgcagctgcagcgggcgtgagttgggggaggacgggttgccgactcgcctacctagcggtctcttgattgtcgatattttgttggcataggtttatgtagagacgtatacatatatatagacacactgtctttaaatctaggcctgtatccggtgtccgaggcgaactcagtaagatgatgttaagaggaaacctgaagcaagtgcgcattgagtaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatggtgataaaagaaaatgtggctgaagttacccgaagttcagcttgcagtgtaattcagaagagttaagaccagaagtactggaatcatacttcctttcaggtcaaaacattttgtgggaaatatcctgttcgtgacctaggagaaacaagacagaaaacaaatctttcttcatttatgaatttcttactccatacaagcagtttatggatgtctgggcaatcatagcacttgccatttaaaaacatgctacaggggcacattttctgtggttaaaaatgatctccagaataagtgtaaactgcagttttcctttgcattgagggttttggctttttatttgtaaattaaatcaagatgttacccac

SEQ ID NO: 3987 - DNA, 2965 bp, Homo sapiens
gcgcacggagcgcgggacggagcgccaggcggacggaccgaaggacggaggcaccgaaggacggacgcccccgcacacgcagacgcacagagctcggcgcggcccccgtcgcatacacactggcacagacacaagcagggacacacgcagacacacgcacactcgcgcgcgcatcctcccgccagcctgcccgcctgctcgccggcgcccggagcccgctctggccgcttgctttttgctgagaaagcttcctgccctggaagatggcacccttccccatccagacaccttgggaatgaattatgagggagccaggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgcttgcctgtggggtgctccggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccgcagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtagtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaact

SEQ ID NO: 3988 - DNA, 3484 bp, Homo sapiens
gtgcgagcccggccgccggtgagtcggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccgggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaagtttttattagcttaaagaaataatttgcaatatttgtacatgtacacaaatcctgaggttcttaattttagctcagaatataaattagtcaaaatacacttcaggtgcttaaatcagagtaaaatgtcagctttacaataataaaaaaaggactttggtttaaagtagcaggtttaggttttgctacattctcaaaagacagcaggagtatttgacacatctgtgatggagtatacaacaatgcattttaagagcaaatgcaacaaaacaaatctggactatggataaataatttgagagctgccacccacaaatataaatacagtactcatgctgactgaaataataagacatctacaaatttataaacaaaaagtgattgtcattatcctgcttatgtactagattcaggcaagcattatagactttttggttgcggtggcttttgcatttatattatcaatgccttgcaggaacgttgcattgataggcccattttatttttttattttttttttcgagacaggatctcactctgtagcacaggctggattgcagtgcaatcctgcaattctcaatcttgcactgcagcctcgacctcccaggctccagtgactctcccacctcagcctcctaagtagctgggagtacaggcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtctaatttttactctaggtgccttttatgttcagaactctttccactggactggtatttgctcaaaaataaataatggtagagaagaaaactataaaaatggacaaggctttcttctatcagtagcgtttaccctttgtcaccagtggctttggtatttccatgtctggcattgcataaacttctctggtgtgaaaggataaatatgcctttctaaagttgtatatcaaaattgtatcaatttttattttctatgatttctagaaacaaatgtaataaatatttttaaaatctcctttctactggttatgtaaataaatcaaataaatatatcaaaa

SEQ ID NO: 3989 - DNA, 4447 bp, Homo sapiens
ggccggagctttgcggagggcccggcttggcgggtccgggggggagccgaacccgcggggcaccgggtccgggcggggccgagccgggccggggcgggagccagccggggtggggcggggccgaggccgaggcaggcggtcggcagtgctgggggttcaggtgttgcggcggctccacgtagccaggcggcccgtgggctggagcgggcggagctcggcccgcggcttgcgtgagctcaggccggtcccagcgtccagagcgccggcccttcggcttcttctaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtgggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaagttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccagggccaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacaggggttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctggcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagtgaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataac

SEQ ID NO: 3990 - DNA, 787 bp, Homo sapiens
ggaagctctgagtcactgaatagcaaagaaaaatatgaaagcaagaggaattgctttcacatctagaaaatgttgcaagataatctgaaatcttctggtgctggtgaatgcatgaagaggttcacagtatcttttaaagtacttctgaaaagataaggagtttaaaaggtgggtgtgtacactggcactgagctgcagtaggatttttccttggatagtctggtctggagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacagtaaaaaaaaaaaaa

SEQ ID NO: 3991 - DNA, 2940 bp, Homo sapiens
gcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacagtaaaaaaaaaaaaa

SEQ ID NO: 3992 - DNA, 884 bp, Homo sapiens
cgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactc

SEQ ID NO: 3993 - DNA, 3040 bp, Homo sapiens
aaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctgctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcaaaaaaaaaaaaaaaaaaaa

SEQ ID NO: 3994 - DNA, 3047 bp, Homo sapiens
cccttgcgcctccttgcccggccgcgcccagcccggcgtcccgagcagcgcaggggaggatccccgcgcagtgacccgggagccaccacagactctgggaggctcggcggctggagcagcaggcagctccccgcagctcccggcgcttccaggcagctctctgagccgtgccagaggcccggcccgccattcccagccccgagccatgatgaagactttgtccagcgggaactgcacgctcagtgtgcccgccaaaaactcataccgcatggtggtgctgggtgcctctcgggtgggcaagagctccatcgtgtctcgcttcctcaatggccgctttgaggaccagtacacacccaccatcgaggacttccaccgtaaggtatacaacatccgcggcgacatgtaccagctcgacatcctggatacctctggcaaccaccccttccccgccatgcgcaggctgtccatcctcacaggggatgtcttcatcctggtgttcagcctggataaccgggagtccttcgatgaggtcaagcgccttcagaagcagatcctggaggtcaagtcctgcctgaagaacaagaccaaggaggcggcggagctgcccatggtcatctgtggcaacaagaacgaccacggcgagctgtgccgccaggtgcccaccaccgaggccgagctgctggtgtcgggcgacgagaactgcgcctacttcgaggtgtcggccaagaagaacaccaacgtggacgagatgttctacgtgctcttcagcatggccaagctgccacacgagatgagccccgccctgcatcgcaagatctccgtgcagtacggtgacgccttccaccccaggcccttctgcatgcgccgcgtcaaggagatggacgcctatggcatggtctcgcccttcgcccgccgccccagcgtcaacagtgacctcaagtacatcaaggccaaggtccttcgggaaggccaggcccgtgagagggacaagtgcaccatccagtgagcgagggatgctggggcggggcttggccagtgccttcagggaggtggccccagatgcccactgtgcgcatctccccaccgaggccccggcagcagtcttgttcacagaccttaggcaccagactggaggcccccgggcgctggcctccgcacattcgtctgccttctcacagctttcctgagtccgcttgtccacagctccttggtggtttcatctcctctgtgggaggacacatctctgcagcctcaagagttaggcagagactcaagttacaccttcctctcctggggttggaagaaatgttgatgccagaggggtgaggattgctgcgtcatatggagcctcctgggacaagcctcaggatgaaaaggacacagaaggccagatgagaaaggtctcctctctcctggcataacacccagcttggtttgggtggcagctgggagaacttctctcccagccctgcaactcttacgctctggttcagctgcctctgcaccccctcccacccccagcacacacacaagttggcccccagctgcgcctgacattgagccagtggactctgtgtctgaagggggcgtggccacacctcctagaccacgcccaccacttagaccacgcccacctcctgaccgcgttcctcagcctcctctcctaggtccctccgcccgacagttgtgctttgttgtggttgcagctgttttcgtgtcatgtatagtagtagaaatggaaatcattgtactgtaaaagcctagtgactccctccttggccaggccctcacccagttcagatccacggcctccacccgggacgccttcctcctctgctcccaaacagggtttccgtggcctgtttgcagctagacattgacctccgccattgagctccacggtttacagacaattgcacaagcgtggggtgggcaggccaggactgcttttttttaatgctcccatttcacagaggataccaccgagactcggaggggacacgatgagcaccaggccccacctttgtcccctagcaaattcagggtacagctccacctagaaccaggctgccctctactgtgctcgttcctcaagcatttattaagcacctactgggtgctgggttcactgtgtcctaggaaaccaagagggtccccagtcctggcctctgcccgcccctgctgccccaccaccttctgcacacacagcggtggggaggcggggaggagcagctgggacccagaactgagcctgggagggatccgacagaaaagctcagggcgggtcttctccttgtgcccgggattgggctatgctgggtaccaccatgtactcaggcatggtgggttttgaacccataaaccaaaggcccttgtcatcagctcttaacaagtatattttgtattttaatctctctaaacatattgaagttttagggccctaaggaaccttagtgatcttctattgggtctttctgaggttcagagagggtaagtaacttcctccaggtcacacagcaagtctgtgggtggcagaagcaagctagcgctgggcattcagtacataccacgatgtgctccctctcttgatgcttggcccctggggccttcagggctttgggacatcttgtcctcaaccctctccctagatcagtctgtgagggtccctgtagatattgtgtacaccatgcccatgtatatacaagtacacacagatgtacacacagatgtacacatgctccagccccagctctgcatacctgcacctgcaccccagccttggcccctgcctgcgtctgtgctcaaagcagcagctccaaccctgcctctgtccccttccccacccactgcctgagccttctgagcagaccaggtaccttggctgcaccggtgtgtggcccgctctcacccaggcacagccccgccaccatggatctccgtgtacactatcaataaaagtgggtttgttacaaaaaaaaaaaaaaaaaaaaaaaaaaaaaaaaaaaaaaaaaaaaaaaaaaaaaaaaaaaaaaaaaaaaaaaaaaaaa

SEQ ID NO: 3995 - DNA, 4078 bp, Homo sapiens
atgcagaagagcgtgcgctacaacgaggggcacgccctgtacctggcctttctggcgcgcaaggagggcaccaagcgcggcttcctgagtaagaagacggccgaggcgagccgctggcacgagaagtggttcgccctctaccagaatgtgctcttctacttcgagggcgagcagagctgccgcccggcgggcatgtacctcctggagggctgcagctgcgaacgaacgcccgcgccacccagggccggcgccgggcagggaggcgtccgagacgcgctggacaagcagtattactttactgttctttttggccatgaaggtcagaagccactggagctgcgctgtgaggaggagcaggatggtaaagagtggatggaggccattcaccaagccagttatgcagacattttgattgagagggaagtattaatgcagaagtacattcatctagttcagatcgtagagacagaaaaaattgcagctaaccaactccgacatcaacttgaagatcaagacacagaaatcgaaaggcttaaatcagagattattgctcttaataaaaccaaagaacgaatgcgaccttaccaaagcaaccaagaagacgaagatccagacatcaagaagattaaaaaggttcagagcttcatgcgaggatggttgtgcagaaggaaatggaagaccatcgtgcaggattacatttgttctcctcatgctgaaagtatgaggaagagaaaccagattgtgttcaccatggtggaggcagagtcagagtacgttcaccagctctacatcctggtcaatggctttctccggcccctgcgtatggccgccagctccaagaagccccccatcagccacgacgacgtcagcagtatttttcttaacagtgaaacaatcatgtttcttcatgaaatatttcatcaaggactaaaggcaaggatagcaaactggcccactttaattttagctgatctgtttgatattttgctccccatgctgaacatttatcaagaatttgtgcgtaatcaccagtacagcctgcaagttctcgccaattgtaagcaaaacagagattttgacaaactcttaaaacagtatgaagccaatccagcctgtgaggggaggatgctggagacattcttgacctatcccatgtttcagatccccagatatatcatcacactccatgagctccttgctcacacaccccatgagcatgtggaaaggaaaagcctggagtttgccaaatcaaagctagaggaactatccagagtaatgcacgatgaagtcagcgacactgaaaacataaggaaaaaccttgccatcgaaagaatgatcgtggagggctgtgacatcttgctggacaccagccaaacgttcatccgccaaggttctcttattcaagtaccttccgttgagagggggaaacttagtaaagttcgcctgggttcgttgtctttgaaaaaggaaggagagagacaatgcttcttatttacaaaacactttttaatatgtacaagaagttcaggagggaagcttcatctgctcaagacaggtggggttctgtctctaatagactgcacattgattgaggagccagatgcaagcgatgatgactctaaaggttctgggcaagtgtttgggcacctggattttaaaatagtggtggagcctcctgacgctgccgccttcactgttgtcttgttagcaccctcacgccaggagaaagctgcctggatgagtgacatcagtcagtgtgtggacaatatacgatgtaatggtttaatgactatagtgtttgaagagaattccaaagtcactgtgccacatatgattaagtctgatgcccgtcttcataaagacgacactgacatttgcttcagtaaaacactcaactcctgcaaagtgccccagatccgttatgccagcgtggagcgcctcttggaacgactgacagacttgcggtttcttagtattgatttcctcaacacctttctgcacacctatcgtattttcactactgccgctgtggtgctggggaaactctccgacatatacaagaggcctttcacctccatccctgtcaggtcattggaattgttttttgctaccagccagaacaacagaggtgaacatttggtggatggcaaatccccacgtctgtgtcgcaaattctcttccccgccaccactggctgtgtccagaacatcttccccagtgagggccagaaagctgtctttgacttctcccttgaactcaaagataggagcattggacctgacaacttccagcagtcccaccaccaccacccagagtcccgctgcgtctccaccaccacacactggtcagataccactggatctcagcagaggcctctcttctccagagcaaagcccgggaacggtagaagagaatgtcgataacccacgcgtggatctgtgtaacaagctaaaacgaagtattcaaaaagcagtcctagagtctgcaccagcggaccgagcaggagtggaaagctcccctgcagcggacaccacagaactttcaccttgcagatccccctcaactcctcggcacctccgctatcgacagcctggaggacagacggcggacaatgcccactgctctgtttcaccggcttctgcttttgcaatagccacagctgcagcaggacatgggagtccaccaggctttaacaacaccgagagaacatgtgataaagagtttattatacggagaacggctaccaatcgagttctgaacgtcctccgtcactgggtctcaaagcacgcacaggatttcgaactcaacaatgaactaaagatgaatgtcctaaatttgctagaagaagttttgcgagacccagaccttcttccccaagaaaggaaagccgccgcgaatatcctcagggccctttcacaagatgaccaagatgacatccacctaaaattagaggatataattcaaatgactgactgcatgaaggccgaatgctttgagtccttgtcggccatggagctggcagaacagatcaccctcctggaccatgtcattttcagaagcattccctacgaggagtttcttgggcaggggtggatgaagctggataaaaacgaaagaactccttacattatgaaaaccagccaacacttcaatgacatgagtaacctggtggcctcccagataatgaactatgctgatgtcagctcccgtgccaacgccatcgagaaatgggtggcagtggcggacatctgccgatgcctgcacaactacaacggcgtgctggagatcacctcggccttaaacagaagtgccatctacaggctgaagaaaacctgggccaaggtctctaagcagacaaaagctctaatggacaaacttcaaaagactgtttcctctgaaggaagatttaaaaatcttagagaaacccttaaaaattgtaaccctcctgcagttccttatcttgggatgtacttgacagacctggcatttattgaagaaggaacaccaaactttactgaggaaggccttgtcaatttctccaaaatgagaatgatatcacacatcatcagagagatacgccagttccagcagacttcctacagaatagatcatcagccaaaggtcgcacagtacttgcttgacaaagaccttatcatagatgaagatacgctatatgagctgtcactaaaaattgaacctcgactccctgcttgaagatctggccttgcccctgagtccacgggatgttcatggaaagcaggacagacagaattgtgtatgccttgcctatcacggtacagcacgaagccaggctcctttctccaccaaagaagatggaaccagactggaattctgtctccagagagaaacccagctgtttgggtcaaagacagatgcttcagacttgggtgggaaggtgaaagatggctatttagaaagctggtggcacgttttacataagggaatgtcagatgggagatgctagttgccattttaacaaagcaggtaaatcggtaaattttaaactctgtccatgttctgttagaactcagggacaaggatccatgaaaaagacctg

SEQ ID NO: 3996 - DNA, 1968 bp, Homo sapiens
tctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaaaaaaaaa

SEQ ID NO: 3997 - DNA, 1674 bp, Homo sapiens
actgttgagcaggcctctctgcctgtggccttccggccggtttccagacgcccaggtggccaacattagagtccgcgtagcagtgtgagattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaaaaaaa

SEQ ID NO: 3998 - DNA, 1825 bp, Homo sapiens
gcgatctacgtttcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaaaaaaaaaaaaaaaaaaaaaaaaaaaaaaaaaaaaaaaaaaaaaaaaaaaaaaaaaaaaaaaaaa

SEQ ID NO: 3999 - DNA, 1979 bp, Homo sapiens
tctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgcctctctgcagattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaaaaaaaa

SEQ ID NO: 4000 - DNA, 1979 bp, Homo sapiens
tctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcattgcaagttcacctgccactaccgctgccgcgcgctcgtctgcctggactgttgcgggccccgggacctgggctgggaacccgcggtggagcgggacacgaacgtgcccatcttgcaggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaaaaaaaa

SEQ ID NO: 4001 - DNA, 1876 bp, Homo sapiens
tctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaaaaaaaaaaaaaaaaaaaaaaaa

SEQ ID NO: 4002 - DNA, 1749 bp, Homo sapiens
tctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaa

SEQ ID NO: 4003 - DNA, 2763 bp, Homo sapiens
ttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccagggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttctttttaaaaaaaaaaaaatttatttgaccgaaaaaaa

SEQ ID NO: 4004 - DNA, 2817 bp, Homo sapiens
ttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttctttttaaaaaaaaaaaaatttatttgaccgaaaaaaa

SEQ ID NO: 4005 - DNA, 1600 bp, Homo sapiens
ttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcctcaagatcagccatcttgacatcactctctcatgttgtatgtgttagcttttgctgaaatataaaccatcccaaacttaaa

SEQ ID NO: 4006 - DNA, 1596 bp, Homo sapiens
ccgcgggacgcatgcgcacggcggacggaggcgagccggccggggcttcctccccggccggcagggtggacggtgggctccagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttaaaaaaaaaaataaagggatatggctgttgtagaaagatagcgtatttgcatttacaataacagtagcatgttgtcagtggccaaggctacacagaaggctccctgctgcccggagcaggtacatccacagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcaatgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaaaaaaaaaaaaaaaaaa

SEQ ID NO: 4007 - DNA, 2102 bp, Homo sapiens
cattaaccaaacaaagagaagcagagtggatcctgtgctaatattgggaaaaccaggcaacaggactcatttggggcctttattgtgaaaacatgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagtccttcccgcctgcacagctcccagactcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccggctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccgcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttaaaaaaaaaaataaagggatatggctgttgtagaaagatagcgtatttgcatttacaataacagtagcatgttgtcagtggccaaggctacacagaaggctccctgctgcccggagcaggtacatccacagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcaatgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 4008 - DNA, 4250 bp, Homo sapiens
ccggcctcggcctccctgggcggccgtattgtctaagctccatagcaaccccggcgcggcgccggccacgctagccagcgtagctccggagcccgcgcgccgtcgccgcgtcgctcaggccctgacccgcgctggacccgcgcgctagggccctgacggcccgcgcgggctccaggcgcgggcagcggggacggcatgcccgagaagaggctcaccgcggagccaccaactattacagaagaagaatttgaagattctctggcaacagatgatttccttgtagactactttaatgaattcctaagccttccaaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaaaggaaagaatgaggttaaacctgttcaaatgaatgcccccgatgaagatgagaccattaatgtcaactacaatattatgtgtctcagtcgtgaagaaggtattaagtggatcaaaaaagaaagacttccagcatttctggaaagtgattgttactttgaatacaggttagccaaattggtctcacaagtaagatggagcaagtccggcatgaatttcacagtaggatcaaatttttctccctggatcgtgaaaaaaccacccagtctaccacctcctgccactgaagaagataatcttgtaattatgaaaaagttttatgtatcacttggtgaggcttcctatactcaaacaaaagattggtttgcattagcaaaacaaagtcagcaaacagtatcaaccttttcgttaccctgttgtgtaccctacaacaaacttaaatcaccagctatttcatctgtttctgagaattttatctttgatgatggagttcaccctaggacaaaaaaggacccatctaaaaccaacaaattgatttctgaatttgaagaagaagaaggagaagaagaagaggtgtctgtatctctacaagacactccttctcaagctcttctgagagtataccttgaaaagaaacaggatgttgatgaaagcctgacaatgcatttctcaacatgtgaagaatttttaagctcctatatatactttattttgagaggagcaattcagcaaattgttggaaagccagttggagaaaccccagactatataaacttcaacaatataacaaaagtgtcatttgatgattgttttgagtctattcatggcaagaattttttaagtgaattagttcaaactacaaaggagaggtcagaagagatagaacaaacaagtttaagttcaaagaatgagagcgctggaccagagagcagggcggactggtgtatttctcataggacttatgacattggcaatagaaaggagtttgaaagatttaagaaatttataaaaggtacattgggagagagatattggtggctatggatggatattgagaggttaaaagttcttaaggatcctggaagacatcaaagacatcttgagaagatgaaaaaatgctatctagtgagcaatggagattactacctttctgcagaaatcttatcaaaatttaaactgttagatggatcacagtggaatgaagagcatttaagaaatattcagtctgaagttttaaaacctttacttctgtattgggcaccaagattctgtgttactcattcagcctcaacaaaatatgctagtgctgaactgaaattctggcacctccgtcaagcaaaaccaaggaaggatattgacccttttccacaaatggcaaccctcttgccattaagacccaaatcttgcattccacagatacctgagatccagaaagaagaattcagcttatcacaacctcctaaatctcccaataaatcacctgaagtaaaaacagcaactcaaaagccttggaagcgggagcttttgtatccaggttcttctaaggatgatgtgattgagaaagggtcaaagtacatgtcagaaagcagcaaagtcattcatttaacatcttttactgacatttctgaatgtctcaagccccagctggatagaagatacgcttatacagaagaacctagggttaaaaccgtgtcagatgttggtgccttgggaggatctgacatggaaaatttgttgcaatctttgtatgtagaaaatagagctggattcttctttactaaattctgcgagcattcagggaacaagttgtggaagaacagtgtgtacttttggtttgacctgcaggcttatcatcagcttttctaccaagaaacacttcagccttttaaagtatgcaagcaagcgcaatatctttttgccacatacgttgctccttctgccactcttgacattggactccaacaggaaaagaaaaaagaaatttatatgaaaatacagccaccatttgaagacctttttgacacagcagaggaatatatccttctcctccttcttgagccatggacaaagatggtaaaatcggaccaaattgcttataaaaaggtggagctggtggaagaaactcgacagttagactccacatacttcagaaagctacaggctttgcataaagagacattttccaagaaagctgaggacaccacttgtgaaattggaactggcattttatcactctctaacgtctctaaacgaacagaatattgggataatgttcctgcagaatacaagcattttaagtttagtgatctgcttaacaacaaactggagtttgaacatttccgtcagtttcttgagactcattcttcaagcatggatcttatgtgctggacagacattgagcagttccggagaataacttacagagatcgaaatcaaaggaaggcaaaatctatatacattaaaaacaaataccttaataaaaaatatttctttggacccaacagtccagcttctctgtatcagcagaaccaggtaatgcatttaagtggtggctgggggaagattcttcatgagcagcttgatgcacctgttctagttgaaatccagaagcatgtgcaaaataggctagaaaatgtatggctgccattgtttcttgcaagtgaacagtttgcagcacgtcagaagataaaggtacagatgaaagacatagcagaagagctcttactacagaaggctgaaaagaaaatcggggtctggaagcctgtggagagtaagtggatctcttcatcttgtaaaatcattgcttttcgcaaagcattattgaatccagttacttcaagacaatttcaacgttttgtggctctaaaaggagatttattggaaaatggtttactcttttggcaagaagtacaaaaatataaggacttgtgccattctcattgtgatgagtctgtcatccagaagaagattacaactattatcaactgctttattaattccagtattccaccagctttacaaattgacattccagtagagcaagcccagaagattattgaacaccggaaggagttaggaccatatgtatttagagaggcacagatgacaatttttggggttctgtttaaattctggcctcagttctgtgagtttaggaagaatttaacagatgaaaatattatgagtgttttagagagaagacaagaatataataagcagaaaaaaaaattggcagtcctagaagacgaaaaatctggaaaggatggaatcaaacaatatgcaaatacttcagtgcctgctatcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggcttgcaacctctcacaaattttaaggctagctcttcaactatgtctttgaaaaagaatatgtctgcccacagcagccagaagtgacagcattcttgtgaatgtttacatcctgctgctgataggttcaaggaattctttaaaccagattctgctgacatgagaagctccagtgatttgtttttttgaaggtctgtatcagagcaagcctaacatctaaataaagtttgattctggattttccaggtgggaaataaataaagaaaatttggcttgtcttaaaaaaaaaaaaaaaaaaaaaaaaaaaaaaaaaaaaaaaaaaaaaaaaaaaaaaaaaaaaaaaaaaaaaa

SEQ ID NO: 4009 - DNA, 2769 bp, Homo sapiens
aagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcccatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaaaa

SEQ ID NO: 4010 - DNA, 1396 bp, Homo sapiens
gacatttccgagagagcgggagcgtctgtacctctgcggcgtcactgggagcccgacggaaaactgcgctaaaggcttgtctttcccctgcccgaccgaaggagccgaccttgcctgcgctacagcttccttattttcgtcgcctgttctcctgatcctgcgtgttctaaaaaccccttaggctttccatgggttcccagaccatggcggtggcgctgcccagggacttgcggcaggacgccaacctggcaaagaggaggcacgcggagctgtgcaggcagaagcgggtcttcaacgccagaaacaggataattgggggagacactgaagcctgggatgttcaagttcatgaccagaagataaaagaagctactgaaaaagctagacatgaaactttgctgctgaaatgaggcaaaatgacaaaatcatgtgcatattggaaaaccggaaaaagagggataggaaaaatctctgtagggctatcaatgacttccaacagagctttcagaagccagaaactcgccgtgaatttgatctgtccgaccccctagcccttaagaaagatcttccagcccggcagtcagataatgatgttcggaatacgatatcaggaatgcagaaattcatgggagaggatttaaacttccatgagaggaagaaattccaagaggaacaaaacagagaatggtctttgcagcagcaaagggaatggaagaacgcccgtgctgaacaaaaatgcgcagaggccctctacacagagacaaggctgcagtttgacgagacagccaagcacctccagaagctggaaagcaccaccagaaaggcagtttgtgcatctgtgaaagacttcaacaagagccaggccatcgagtcagtggaaaggaaaaagcaagagaaaaagcaagaacaagaggacaacttggccgagatcaccaacctcctgcgtggggacctgctctccgagaacccgcagcaggcagccagctccttcgggccccaccgcgtggtccctgaccgctggaagggcatgacccaggagcagctggagcagatccgcctagtccagaagcagcaaatccaggagaagctgaggctccaggaagaaaagcgccagcgagacctggactgggaccggcggaggattcagggggctcgcgccaccctgctgtttgagcggcagcagtggcggcggcagcgcgacctgcgcagagctctggacagcagcaacctcagcctggccaaggagcagcatttgcagaaaaaatatatgaatgaagtctatacaaatcaacccacgggagactatttcacacaatttaatacaggaagtcgataatgaggaacacacccttgttcccgtcattcacgtataaagagtggctaccttaaagagtca

SEQ ID NO: 4011 - DNA, 6203 bp, Homo sapiens
aacagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactcttcccacagtgttcagatttgtcctgtgtgtgtttacagtattcaatttattgcagttatagaattggtcagagagcattttcatagtgtgctcatttctatggttttgttatatagcatttttcaacatttaatggtctgtacagttgaatgtaagtgttcaatatgtattgctgaagttataagtttaaaactcaatttcagatgctcataaaagttacttagctaaaattttagcaatttattgcattttgaaataatcattaacatgctgcaattcaggagctggttagaacattttaagtggcagcatagaattttggaattttggggctttcttttcagaaattgctaccatagtaattaatgtttccagttatcaagattgtgattagacacatttacctttcttcattgaacaaatggtgccatagttatttttctcaaaatttagtgaaaatccctcccatgtagacatgttgcacattttttccaaatttatacatggaactgcagtaggaatattctcaccatctgatgccatgtacccacttcagaaataagcaatacttgttcctctgttacaacctcagcactttgcaccgtaggagccattgttaaagttgtcacttgtgtaactgactgcttttccaaaactggtacttacgtgaactgttgtccttgctttacaccaccatttggaaaacttaccagtttttagatgtagatgtagtgaaaaacttcaagaatgaagcagagcaattgagtattcttttttaaattattaagccatgatttacaaaaacattactttctgtaattcacaatacttgttttaaaaacatagtgtcttcattagtgtgcatctattaactgttcatggtgttagagttgcaaactttttagcaagaaaatatggatttcctcatttcagttccttctgcagcctgtgaatctccacaaagtgttaccagtttacaaaaataagtctttttgccttaagtcattttggaaataagtaatactgcatctgactctggtggctgtattagctaggaaaggtttgtaaatggtgtcagtgaggtggggaaaggaagtcttcctgtcacatatgcaggttcgttttcattctagggcagtgccaggaagtatattgatagctttgtaggtacaggaaaaacatcatcattatttcctctgttcacatttactggtcttaattaacaggtaataataatacatgtacttttagcctgaaacctcttccacgccatgggtaacttgggggagagaagaatcctccaaacgatggagtagccagtggtaatacaaagcagggagaacagaaaggtagagttactaaggccttcagtgaacagaaaggagcagagagcaagattagatctgagaagatgctctggggactgagcccactgttgttggtgtcagggaggcttactggagccacacctgcaggcgctgtgttcaggcaccaccttcctccttgagctttgcctgtctcttgccttatcagttcttcctccaccaccctacacccccctccccccggccccaagcccctgtgtctccttgttacaattaagtttctggatattgacttaagaactgttaggaagaggactagaaaaggcttcccctgcctatcctctccgatcaccaaggtggaagggagctagtaggactcttccttgacacaccttgtagtctaaatgttcggtattctattcaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccattattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagaccaccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctg

SEQ ID NO: 4012 - DNA, 2390 bp, Homo sapiens
tccacgttccgcgcagaggaacgtggctccaaattcaaatcaacgcagcctcacgccggcggcgagcgcgaggggcggagcctgcccggcgtgggccgagacgcgctgtgtgattgcctcggagagaggaaggcgctccagttccgggtcaggcccttctcccgcctccctcggccttagccatggcgagtagcagcggtgctggggcggcggcggcggccgcggcggcgaatctgaatgcggtgcgggagaccatggacgttctgcttgagatttcaagaattttgaatactggcttagatatggaaactctgtctatttgtgtacggctttgtgaacaaggaattaacccagaagctttatcatcggttattaaggagcttcgcaaggctactgaagcactgaaggctgctgaaaatatgacaagctgactttctggagaaattctgatgagatatgtcaagctctgcaagagggtttgaagattgcattgtagttgagaatgtacaatgaaattactgcatgcagcagtgtagaaaaattttactttttaaaagaattataaaaccatagctttataaatcagtggaaagtggcttacagagagaactatcagatgtgtttacatcacatcttattcactttttttaacagctctaatgctttggcattgctatgttcatatttatgtattccttatttatagctctgatagctttaattttctaagcagtctgtctatcagatgtgcacatctgctgtgccaggttgaagtatagtggaacccatcagtagtaatgtgtagtagttatgacttgttgacatttccattataaactttaattttgaattgtttatgcattataactgtggatttatattgtattgggctgaaagttgacaggatttcagccaccacttgtgaatttttatttagattcattatgtatatcagaatcttgttttttgaaataagagcatggaaaacatttcttgtaatctactcttgaacaaagaatatttagtttttcaaacagtttgttgggcagctaatagtgtgaaccaggtcatttttgtattgagtaaaaaaatcaaactttgagaaacttggattttaaaagtaatgacaatgcttaggttagtattatttgtaatttgaatcatttacatctaatgagaatgttagttgagaatgttttcttaaagttttatatcctataaataacggaataaaaaaatttgtaaaatgaaacaacaaacatgcaaaattcctatttacttttattacataaaagtaattttagtgcttacctaataaatcttgaatggttatttaataaattattagatgggtgatgtgtttcaaaagatacttgctattttttgaagaaataaggatttccagtcattaaacaaaactaaacaatcttattagatgggtgatgtgtttcaaaggatacttgctattttttgaagaaataaggatttccagtcattaaacaaaactaaacaatcaaatgttctatattaggaatctcaagtatggctttttttaaaaaacctttttaacatcttgatgtcaaggattataagtatggcttttcagaattgttttgtttgtcattattcttgcctttaaaattttaactcatcaaagtgaagattagaaataaattttagaaaatgtagaatagtattgattctgttcctgtaatagaatctcagtggagtttttttgcaaaactaatatggatttcatctgattttattatttcttaaattttagattttattgagtaccatttatatgattgtacaagcattcactctttactagcattttttgtttttcagacaagctgaagtggttttattaagatttggtaatatttaaatagcaaccttctctgcctttttttttttttaatatagaattttgaccattttgactttttaaatgcctggcatctttaccaaccaagtaaactggaagatctgttactggtagaacaggttgaggagacagtaggaatttgtaaaaagtcatttgatttataatcaacactacaaatactatgtgttatttataaaatcataaagaacacttttgtcagactccaaaatttgtatatacttccaggccataagagttgatagtattatttatgactttgtagattaagttatttatgtatgaaacaaagcaggaaaatatattgagaagggatcgtgtttacagaggacttctttaaagtgtcacatttttaaaatgtaaacatatttttaatgcatacttaagtaatatttaagaaactaaacaaaataatgatacaattgcagtgttgtgcttgttgtcaatgacaaaaataaaaccattttggtggtattgg

SEQ ID NO: 4013 - DNA, 2390 bp, Homo sapiens
tccacgttccgcgcagaggaacgtggctccaaattcaaatcaacgcagcctcacgccggcggcgagcgcgaggggcggagcctgcccggcgtgggccgagacgcgctgtgtgattgcctcggagagaggaaggcgctccagttccgggtcaggcccttctcccgcctccctcggccttagccatggcgagtagcggcggtgctggggcggcggcggcggccgcggcggcgaatctgaatgcggtgcgggagaccatggacgttctgcttgagatttcaagaattttgaatactggcttagatatggaaactctgtctatttgtgtacggctttgtgaacaaggaattaacccagaagctttatcatcggttattaaggagcttcgcaaggctactgaagcactgaaggctgctgaaaatatgacaagctgactttctggagaaattctgatgagatatgtcaagctctgcaagagggtttgaagattgcattgtagttgagaatgtacaatgaaattactgcatgcagcagtgtagaaaaattttactttttaaaagaattataaaaccatagctttataaatcagtggaaagtggcttacagagagaactatcagatgtgtttacatcacatcttattcactttttttaacagctctaatgctttggcattgctatgttcatatttatgtattccttatttatagctctgatagctttaattttctaagcagtctgtctatcagatgtgcacatctgctgtgccaggttgaagtatagtggaacccatcagtagtaatgtgtagtagttatgacttgttgacatttccattataaactttaattttgaattgtttatgcattataactgtggatttatattgtattgggctgaaagttgacaggatttcagccaccacttgtgaatttttatttagattcattatgtatatcagaatcttgttttttgaaataagagcatggaaaacatttcttgtaatctactcttgaacaaagaatatttagtttttcaaacagtttgttgggcagctaatagtgtgaaccaggtcatttttgtattgagtaaaaaaatcaaactttgagaaacttggattttaaaagtaatgacaatgcttaggttagtattatttgtaatttgaatcatttacatctaatgagaatgttagttgagaatgttttcttaaagttttatatcctataaataacggaataaaaaaatttgtaaaatgaaacaacaaacatgcaaaattcctatttacttttattacataaaagtaattttagtgcttacctaataaatcttgaatggttatttaataaattattagatgggtgatgtgtttcaaaagatacttgctattttttgaagaaataaggatttccagtcattaaacaaaactaaacaatcttattagatgggtgatgtgtttcaaaggatacttgctattttttgaagaaataaggatttccagtcattaaacaaaactaaacaatcaaatgttctatattaggaatctcaagtatggctttttttaaaaaacctttttaacatcttgatgtcaaggattataagtatggcttttcagaattgttttgtttgtcattattcttgcctttaaaattttaactcatcaaagtgaagattagaaataaattttagaaaatgtagaatagtattgattctgttcctgtaatagaatctcagtggagtttttttgcaaaactaatatggatttcatctgattttattatttcttaaattttagattttattgagtaccatttatatgattgtacaagcattcactctttactagcattttttgtttttcagacaagctgaagtggttttattaagatttggtaatatttaaatagcaaccttctctgcctttttttttttttaatatagaattttgaccattttgactttttaaatgcctggcatctttaccaaccaagtaaactggaagatctgttactggtagaacaggttgaggagacagtaggaatttgtaaaaagtcatttgatttataatcaacactacaaatactatgtgttatttataaaatcataaagaacacttttgtcagactccaaaatttgtatatacttccaggccataagagttgatggtattatttatgactttgtagattaagttatttatgtatgaaacaaagcaggaaaatatattgagaagggatcgtgtttacagaggacttctttaaagtgtcacatttttaaaatgtaaacatatttttaatgcatacttaagtaatatttaagaaactaaacaaaataatgatacaattgcagtgttgtgcttgttgtcaatgacaaaaataaaaccattttggtggtattgg

SEQ ID NO: 4014 - DNA, 942 bp, Homo sapiens
tacgaatctcgcgagaagtcaagttctcatgagttctcccaaaatccaccgctcttcctctttccctaagcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaaaaaaaaaaa

SEQ ID NO: 4015 - DNA, 693 bp, Homo sapiens
tacgaatctcgcgagaagtcaagttctcatgagttctcccaaaatccaccgctcttcctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaaaaaaaaaaa

SEQ ID NO: 4016 - DNA, 1449 bp, Homo sapiens
cttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaacatgaaaaaaaaaaaaaaaaaa

SEQ ID NO: 4017 - DNA, 766 bp, Homo sapiens
acgcgatacaagtacgtaatgacgacagacgttctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaccttcttcttaaaaaaaaaaaaaaaaaaa

SEQ ID NO: 4018 - DNA, 842 bp, Homo sapiens
ctggggcccgctgtcggtctcccgtcctccgacatcttgtctggaacttccgcctggcagtctccagtaggagtggagctctgtgcggcgtagtttggtggaaaaacgggccttgcgtcggcctcacccccagtgtttgtgtttcagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaccttcttcttaaaaaa

SEQ ID NO: 4019 - DNA, 5735 bp, Homo sapiens
gcgtcccttggcttccgacatcccgtctggccgtccccctgtgccggtccgagcctctgtttatttcctttcctactatcaatactcgaccagcagaaaaggaaagtttaaaaatgccaatcgcacagttgctggaactatggaaaaagatcgaggtggagcctatggaaatagagaccacagaggaggatctcaacctggatgtggagcccaccacagaagacactgcagaagaagaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagcagggaggcggcgcccgccctcgccgtgtccgtgttttctttttcagccccggagagggtcctgacctgggggcttctccaagcctcactgcgccagcctccccgcccgctctcttttctcccaagcgaaaccaaatgcgccccttcacctcgcgtgcccgtgcgaggccgggggcttctttcagagcccgcgggtcctctcatacatggcttctgtttctgccgagagatctgttttccaattatgaagccggtcggtttggtcagactcccgacacccacgtcccaggtacccggtgggaaagtggcagtgcgagggcgcagccattggtggttgcagggccccagagggctggggtgacctggcatcccggggctccccacgggctggatgacggggttggcactgtggcgtccaggaggagatgcctggttctgcccaaaataatccaaagagccgtttcctcctcgcccttcagtttttgcctgaggtgctgggtagcccatcctttcctctgtcccagattcaaatgaggagtaagagcccagacgagaggaaggcaggctggatctttgccttgagagctccgtgtcaccaggatggaagggggtgcctctcggaggagcctgtgtccacctccagtctcggctttccccggggggccaagcgcactgggctgccgtctgtccccagctcccgtggccacacagctatctggaggctttgcagggagtcgtgggttctcgcacctgctcagccctgtgtcggcttcctgtgtgctcacctaaagctgtggttttgctgtgttcacttcgatttttctggtctgtggagaaactgtgaattggagaaatggagctctgtggcttcccacccaaaccttctcagtccagctggaggctggagggagacacaggccccacccagcagactgaggggcagaggcacaggtgggagggcagcggagatcagcgtggacaggagcgatgcactttgtagatgctgtggctttgtgttgcgttttgtgtctctgttgcacagatctgttttttcacactgatccgtattcccctgggtgtgcacacagggcgggtgtggggcatttaggccatgctgtgctctacttcattgagtaaaatcgagtgagaggttccgggcagcaggatcgacgcccagtccagccggcagagggaacacacgggtccttcattgtcctgtaagggtgttgaagatgctccctggcggcccccaagcagactagatgggaggaggcgccgctcagcccctcaccctgcatcactgaagagcggcgcctctgcagcaagcagggcttcaggaggtgcccgctggccacagccaggttttccctaagaagatgttattttgttgggttttgttccccctccatctcgattctcgtacccaactaaaaaaaaaaaaataaagaaaaaatgtgctgcgttctgaaaaataactccttagcttggtctgattgttttcagaccttaaaatataaacttgtttcacaagctttaatccatgtggattttttttttcttagagaaccacaaaacataaaaggagcaagtcggactgaatacctgtttccatagtgcccacagggtattcctcacattttctccatagaagatgctttttcccaaggctagaacgacttccaccatgatgaatttgctttttaggtcttaattatttcacttctttttagaaacttaggaagaagtggataatcctgaggtcacacaatctgtcctcccagaaatgaacaaaagtcatcaccttttctgcttgctacacaggcaacgattcccccatcagctgcccggaccctttggcctggcttggtgtgcaggcctgtctgtttgcttaaagtcagtgggttctggtgcagggagtgagaagtgggggaagtgaaagggaaagcatccgtgagaaagcggccacggttttccctccttgtgtgcccatggggcaccagctcatggtctttttcagtcatcccagtttgtacagacttagcttctgaactctaagaatgccaaagggaccgacgagactccccatcacagcgagctctgtccttacatgtatttgatgtgcatcagcggaggagaacactggcttggccctgctccgctgagtgtctgtgaaatacctctactttccctcccatatccagaacaaaatgatacttgacatccttccacaaaagtcagcctaaagaagttatggtatcatatgttaaactaagctttcaaaaaccttagtgaaatagcaagtgactgctttcaagcagcagtcgacatgtaaatgaaggtgttcttagaattcgcattttgccagctcagcgcacctccacaacgaatgaaatgctccgtatgatttgcacaaatgacatagacctccccaaaagttaactggctctccttcctcacacagttcatcataacccaaccccccacccccgggtcatgaaaatcacagaacttataaacacattgaaccctagatctcaggcttcctgacctaccgccagtggccccttgctggccaccctatagggtcctccttccctggcagccccccatgtgggagaaatacctgattctcccaatctgcagtgggagagctttgctgaattccatcccaaagtcaaacatgggcaagaggtgaggatttcacttttaccctcaagtccgatttgtctgtgattttaaactaactgtgtatgtattgatgtttggaagattgtttgaattttaaagtgataatagtacttaatgttatccagtattgttcattaaatggtgttatcctaaagctgcacttgggatttttacctaacgctttactgattctctcaagcacatggcaaagtttgatttgcactccgttcatttctgacacgttttgctgcctcctacctttctaagcgtcatgcaaattcgagaatggagaaggacgctgccggtccctgagcggtgtggagagggcggaaggtggactccagcgcagcttgaggggctgaggacggaggctgcagcatctgtgtcgttctactgagcacgcttctctgcctcgctcctgactcagcactttgttcactggctcagcagttatgtttacacatcatttttatgttcctgctttgtaattcatgtttgagatgggtggccactgtacagatatttattacgctttccagactttctgaatagatttttttgaataaacatggttttatgaagtgtaatctttttctagcctaacaat

SEQ ID NO: 4020 - DNA, 5817 bp, Homo sapiens
gcggagaaggaggcggagggagcgattgtggccccggccgcggtggccggcgcggcctgccctttgtgaccgcagctcgcgccccacgccccgcgcccatggccgccgtgccgggctccctggccacgcgtgcccgcccgcggacctgagccccgcgcctgggatgccggggatgcgcgtcccccggccctgcggctgctccgggctgggcgcggggcgatggacctgagcatgaagaagttcgccgtgcgcaggttcttctctgtgtacctgcgcaggaagtcgcgctccaagagctccagcctgagccggctcgaggaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagcagggaggcggcgcccgccctcgccgtgtccgtgttttctttttcagccccggagagggtcctgacctgggggcttctccaagcctcactgcgccagcctccccgcccgctctcttttctcccaagcgaaaccaaatgcgccccttcacctcgcgtgcccgtgcgaggccgggggcttctttcagagcccgcgggtcctctcatacatggcttctgtttctgccgagagatctgttttccaattatgaagccggtcggtttggtcagactcccgacacccacgtcccaggtacccggtgggaaagtggcagtgcgagggcgcagccattggtggttgcagggccccagagggctggggtgacctggcatcccggggctccccacgggctggatgacggggttggcactgtggcgtccaggaggagatgcctggttctgcccaaaataatccaaagagccgtttcctcctcgcccttcagtttttgcctgaggtgctgggtagcccatcctttcctctgtcccagattcaaatgaggagtaagagcccagacgagaggaaggcaggctggatctttgccttgagagctccgtgtcaccaggatggaagggggtgcctctcggaggagcctgtgtccacctccagtctcggctttccccggggggccaagcgcactgggctgccgtctgtccccagctcccgtggccacacagctatctggaggctttgcagggagtcgtgggttctcgcacctgctcagccctgtgtcggcttcctgtgtgctcacctaaagctgtggttttgctgtgttcacttcgatttttctggtctgtggagaaactgtgaattggagaaatggagctctgtggcttcccacccaaaccttctcagtccagctggaggctggagggagacacaggccccacccagcagactgaggggcagaggcacaggtgggagggcagcggagatcagcgtggacaggagcgatgcactttgtagatgctgtggctttgtgttgcgttttgtgtctctgttgcacagatctgttttttcacactgatccgtattcccctgggtgtgcacacagggcgggtgtggggcatttaggccatgctgtgctctacttcattgagtaaaatcgagtgagaggttccgggcagcaggatcgacgcccagtccagccggcagagggaacacacgggtccttcattgtcctgtaagggtgttgaagatgctccctggcggcccccaagcagactagatgggaggaggcgccgctcagcccctcaccctgcatcactgaagagcggcgcctctgcagcaagcagggcttcaggaggtgcccgctggccacagccaggttttccctaagaagatgttattttgttgggttttgttccccctccatctcgattctcgtacccaactaaaaaaaaaaaaataaagaaaaaatgtgctgcgttctgaaaaataactccttagcttggtctgattgttttcagaccttaaaatataaacttgtttcacaagctttaatccatgtggattttttttttcttagagaaccacaaaacataaaaggagcaagtcggactgaatacctgtttccatagtgcccacagggtattcctcacattttctccatagaagatgctttttcccaaggctagaacgacttccaccatgatgaatttgctttttaggtcttaattatttcacttctttttagaaacttaggaagaagtggataatcctgaggtcacacaatctgtcctcccagaaatgaacaaaagtcatcaccttttctgcttgctacacaggcaacgattcccccatcagctgcccggaccctttggcctggcttggtgtgcaggcctgtctgtttgcttaaagtcagtgggttctggtgcagggagtgagaagtgggggaagtgaaagggaaagcatccgtgagaaagcggccacggttttccctccttgtgtgcccatggggcaccagctcatggtctttttcagtcatcccagtttgtacagacttagcttctgaactctaagaatgccaaagggaccgacgagactccccatcacagcgagctctgtccttacatgtatttgatgtgcatcagcggaggagaacactggcttggccctgctccgctgagtgtctgtgaaatacctctactttccctcccatatccagaacaaaatgatacttgacatccttccacaaaagtcagcctaaagaagttatggtatcatatgttaaactaagctttcaaaaaccttagtgaaatagcaagtgactgctttcaagcagcagtcgacatgtaaatgaaggtgttcttagaattcgcattttgccagctcagcgcacctccacaacgaatgaaatgctccgtatgatttgcacaaatgacatagacctccccaaaagttaactggctctccttcctcacacagttcatcataacccaaccccccacccccgggtcatgaaaatcacagaacttataaacacattgaaccctagatctcaggcttcctgacctaccgccagtggccccttgctggccaccctatagggtcctccttccctggcagccccccatgtgggagaaatacctgattctcccaatctgcagtgggagagctttgctgaattccatcccaaagtcaaacatgggcaagaggtgaggatttcacttttaccctcaagtccgatttgtctgtgattttaaactaactgtgtatgtattgatgtttggaagattgtttgaattttaaagtgataatagtacttaatgttatccagtattgttcattaaatggtgttatcctaaagctgcacttgggatttttacctaacgctttactgattctctcaagcacatggcaaagtttgatttgcactccgttcatttctgacacgttttgctgcctcctacctttctaagcgtcatgcaaattcgagaatggagaaggacgctgccggtccctgagcggtgtggagagggcggaaggtggactccagcgcagcttgaggggctgaggacggaggctgcagcatctgtgtcgttctactgagcacgcttctctgcctcgctcctgactcagcactttgttcactggctcagcagttatgtttacacatcatttttatgttcctgctttgtaattcatgtttgagatgggtggccactgtacagatatttattacgctttccagactttctgaatagatttttttgaataaacatggttttatgaagtgtaatctttttctagcctaacaat

SEQ ID NO: 4021 - DNA, 705 bp, Homo sapiens
ctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccaca

SEQ ID NO: 4022 - DNA, 2067 bp, Homo sapiens
gggcggaagcgctgccaggcgtccggagcggagcttccagggtctctgggtcgccagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggctccaaggaaaaaaaaaaaaaaaaaa

SEQ ID NO: 4023 - DNA, 1488 bp, Homo sapiens
gttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgc

SEQ ID NO: 4024 - DNA, 2575 bp, Homo sapiens
gcagatccctgcggcgttcgcgagggtgggacgggaagcgggctgggaagtcgggccgagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagagtccacacccactgggacgtgaacatctctttccgagaggcgtcctgcagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagaggcgctgctgctgccgcgggagctggggcccagcatggccccggaggaccattaccgccggcttgtgtcagcactgagcgaggccagcacctttgaggaccctcagcgcctctaccacctgggcctccccagccacggtgaggacccaccctggcatgatccccctcatcacctccccagccacgatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgttcgcccggcagcaggagctcctgcggaagcagaacctggcccggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaacaaaaaattttaaaagaaaatgtgacttcaaaggaaaggaacaaattttcaaagacttgggggagtgaaggcagagcctggtgcagatggacgaggtctgcagacggagggcagaggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgtcccgtgaaaaaaaaaaaaaaaaaaaaa

SEQ ID NO: 4025 - DNA, 3003 bp, Homo sapiens
ctagttctagatccggcgagtagctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctgggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttgatatgaaattgtctttctccattgcagaaataagctagggaaacactaacccaaaaactttctgtagagctgttcctttggaggcagcatcacttattggcagtaaagactcagtataaaagcaccagcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgaaggaggcattgttctttagttggagttctcatttttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaagttaaaacaaaaaaaaaaaaaaaaaaaa

SEQ ID NO: 4026 - DNA, 7709 bp, Homo sapiens
attttgaagagaggggtcccggggagctccctccaagatctagaggctccgcggccacccctgccgggtcctgccaagacttgctagaaggaacgagtcgcgtgccttagttagttggttcccgtcacaggaagaaacgcctttgcagtgggtttaattgcttctgggccgagcgaattccccgccgtacaactcagtggtgcggactttgcctcctgctaccctgttgctgcgccgagcggggtgggaaagtttctggagttgtcagtcgcgcagcccgtggccacctagacccgaggtgcgggcgcctgcgaagggcccccgcggggtggccggggccgccggggcatgcagcgcgggggcgcggctcggtgacgccgcgggcggggacccggcatccgggcaggctgcgcgcgggtgcggggcgagggcgccgcggggactgggacgcacggcccgcgcgcgggacacggccatggaggacgcgggagcagctggcccggggccggagcctgagcccgagcccgagccggagcccgagcccgcgccggagccggaaccggagcccaagccgggtgctggcacatccgaggcgttctcccgactctggaccgacgtgatgggtatcctggacggttcactgggaaacatcgatgacctggcgcagcagtatgcagattattacaacacctgtttctccgacgtgtgcgagaggatggaggagctgcggaaacggcgggtttcccaggacctggaagtggagaaacccgatgctagccccacgtcacttcagctgcggtcccagatcgaagagtcgcttggcttctgtagcgccgtgtcaaccccagaagtggaaagaaagaaccctcttcataaatcaaactcagaagacagctctgtaggaaaaggagactggaagaagaaaaataagtatttctggcagaacttccgaaagaaccagaaaggaataatgagacagacttcaaaaggagaagacgttggttatgttgccagtgaaataacgatgagcgatgaggagcggattcagctaatgatgatggtcaaagaaaagatgatcacaattgaggaagcacttgctaggctcaaggaatacgaggcccagcaccggcagtcggctgccctggaccctgctgactggccagatggttcttacccaacgtttgatggctcatcaaactgcaattcaagagaacaatcggatgatgagactgaggagtcggtgaagtttaagaggttacacaagctggtaaactccactcgcagagtcagaaagaaactaattagggtggaagaaatgaaaaaacccagcactgaaggtggggaggagcacgtgtttgagaattcgccggtcctggatgaacggtccgccctctactctggcgtgcacaagaagccccttttctttgatggctctcctgagaaacctcccgaagatgactcagactctctcaccacgtctccatcctccagcagcctggacacctggggggctggccggaagttggtcaaaaccttcagcaaaggagagagccggggcctgattaagccccccaagaagatggggacattcttctcctacccagaagaagaaaaggcccagaaagtgtcccgctccctcaccgagggggagatgaagaagggtctcgggtccctaagccacgggagaacctgcagttttggaggatttgacttgacgaatcgctctctgcacgttggcagtaataattctgacccaatgggtaaagaaggagactttgtgtacaaagaagtcatcaaatcacctactgcctctcgcatctctcttgggaaaaaggtgaaatcagtgaaagagacgatgagaaagagaatgtctaaaaaatacagcagctctgtctctgagcaggactcgggccttgatggaatgcctggctcccctccgccttcacagcccgaccccgaacacttggacaagcccaagctcaaggccgggggttctgtagaaagtcttcgcagttctctcagtgggcagagctccatgagcggtcaaacagtgagcaccactgattcctcaaccagcaaccgggaaagcgtcaagtcggaagatggggatgacgaagagccgccttaccgaggcccgttctgcgggcgtgccagggtgcacaccgacttcacccccagtccctatgacacagactcactcaagctcaagaaaggagatatcatcgatataatcagcaagccacccatggggacctggatgggcctgctgaacaacaaagtcggcacgttcaagttcatctacgtggacgtgctcagtgaagacgaggagaaacccaaacgccccaccaggaggcgtcggaaaggacgaccaccccagcccaagtctgtggaggatctcctggatcggattaacctaaaagagcacatgcccactttcctgttcaatggatatgaagatttggacacctttaagctgctggaggaggaagacttggatgagttaaatatcagggacccggaacacagagctgttctcttgacagcagtggagctgttacaagagtatgacagtaacagcgaccagtcaggatcccaggagaagctgctcgttgacagccagggcctgagtggatgctcaccccgagactcaggatgctacgaaagcagtgagaacctggaaaacggcaagactcggaaagctagcctcctatctgccaagtcatccaccgagcccagcttgaagtcttttagcagaaaccagttgggcaattacccaacattgcctttaatgaaatcaggggatgcactgaagcagggacaggaggagggcaggctgggtggtggccttgccccagacacgtccaagagctgtgacccacctggtgtgactggtttgaataaaaaccgaagaagcctcccagtttccatctgccggagctgtgagaccctggagggcccccagactgtggacacttggccccgatcccattccctggatgaccttcaagtggagcctggtgctgagcaagacgtgcctaccgaggtgacagaaccgccccctcagattgtacctgaagtgccacagaagacgaccgcctcttccacgaaggcccagcccctggagcaagactctgctgtcgacaatgcattgctactgacccaaagcaagagattttctgaacctcagaaattgacaactaagaaactggagggctcaatcgcagcctctggtcgcggcctgtcaccccctcagtgtttgcccagaaactatgatgctcagcctcctggagctaaacacggtttagcaaggacgcctctggagggccacagaaaaggacacgagtttgaaggaacacaccatcccctgggcaccaaagaaggggtagatgctgagcagagaatgcagcccaaaattccatcacagcctccacctgttcctgccaaaaagagcagagaacgccttgctaacggactccaccctgttcccatgggccccagtggggccctccccagtcccgatgcgccatgcctgccagtgaaaaggggcagccccgccagccccaccagccctagcgactgtcccccagcactggctcccaggcctctctcagggcaggcgcctggcagcccaccaagcacaaggccgcccccctggctctcagagctccccgagaacacaagcctccaggagcacggtgtgaagctgggcccggctttgaccaggaaggtctcctgtgcccggggagtggatctagaaacgctcactgaaaacaagctgcacgctgaaggcatcgatctcacggaggagccgtattctgataagcatggccgctgtgggattcctgaagccctggtgcagagatacgcagaggacttggatcagcccgagcgggacgtcgccgccaacatggaccagatccgggtgaagcagcttcggaagcagcaccgcatggcgattccaagtggtggactcacggaaatctgccgaaagcccgtctctcctgggtgcatttcgtctgtgtcagattggctcatttccatcggtctgcccatgtacgccggcaccctctccaccgcgggcttcagcacactgagccaagtgccttctctgtctcacacttgccttcaggaggccggcatcacagaggagagacacataagaaagctcctatctgcagccagactcttcaaactgccgccaggccctgaggccatgtagccaggcccggaatgggcctctctggacaagagccaccctttcactgtgcatatgatgctgatgcaattcctccatcatctctggacgtgcagaccagatccagaagaaaggcctggcgtgtggccaaacagcgtgaaaccttggcacaggactgaggatcctctcctccagaaaagccccctcgaggaaataaattagtgcggttctctttgacccccaaagacaagacaagcacttatttttattttcagaagacaaaagaaccaagatgccaactggctgcgaatgctctatctccagtctgtctctgtgtactggtagaggctgggaggagtagggggcagcctgttccatttctgatagtgcccttgctcttctgtctgtcatcttgcaggatgcccgagggccagatgggcttagctaggccaaagtaacagactcaagagttattgtacattactgaccacgctcatttgttcaaaagttagaacatctggctgcaccaggaaaaaaaaaaaaaaaaagtcctgttcttctttagataaacaagagacattttcataattgctttctagcaatcagcttttatttgccttaatataagcttttaagcagttatctaactagtgtccacaaccctgtaaccatacttccacatcttcagcttaggcagacatcgaacctctctgggatgtttccagcaaaagtgagcttttctaatcgtctcattgtaacatggcttattttgtagaggtattcatcagccacacacttcatgttggtttttggtttttaagctaactacaaatctagtaaaaagctatctgaaattcacaaatatcatgtgtgtgcgtgcgtgcgtgcgcgtgtgtgtctgtattcatagtgactgcttttggttttaaccagtttagtatcgttactgtgtggatcgtcgcgctgcagtattgacttggaatcctgaccatgtccatcccaaaattcagtcctcagttaacggatcatgtttgcaaaaggtcactgtgaggctgcatatttcagaaagatgtccttaataagggaagtcatgtataagatgttttctaaaagacttttcagtattacaactaatactattattatccttctttttttatttagataattcttttaatttaaacaaaggttcactatggaaccagacaaatctcattagccatgtgttaagtatttgctactttaaattgttttacaactgatttcagcacattctatccttttttttttttgaaatggagtttcgctcttgtcacccaggctggagtgcaatggcacgatcttggctcactgcaacctcagtctcccaggttcaagtgattctcctgccttagcctcccgagtagctgggattataggcacccaccaccacgcccagctaatttttgtattattagtagagacagggtttcaccatgttggccaggctggtctcaaactcaactcctgacctcaggtggtccacccgcctcagcctcccaaagtgctgggattacaggtgtgagccaccgcacctggcctctgtcctcttttagtctagtgtctggttttctagcaaacagtaaatttaaacaagtaaactattatggtttccattgcttacaaaatgattttcctttacattcttatcatgaacactattttaagcatcaaatgcaatcatctaaaatataaaggtcaatcatttataatagaaacaccttgaccacaagcccttgattgaacattttataatatttcatctacttattaaaacaaataatttcccttgggttggaggggaagtgatttcataaattaattagaaagccatctttagcatattgcttatgtctggatccatgtttctgaggaaaaagacattctcaggtgatgtatttttttcatgcattagtatgcatttttaaaaaataatgcatgtttctttaataattaattttcatcttctataagatgccatgtgaagaagttgtggaaatgtagaataaaaagctaaagctgccaaatttctgttgaactcttaaaaacagctcatgtttgtttgtcctctcgggttgtggcctagcctatttgcaatgtaatgaagctgcagggttcttgtatagctaaagcgttcaatgcatttcacgtgctgtggtggatgtgggtgctgtagacaggcttcttctcttcctgctctcaaaatacctcggcttgacatttggacagatcctgtcattgtttaagctgagcaaaaaaccacacaaaagttgtgtaagagatgagataacaaaggagcgagagaaatctcatgtgaatttccaagttttaattcgttctccatgaaggattttcatttcagtgaaagtcgcagcagaagagggaactttctggagtttttgagaatgccaaaccacatttttatcacacttctttggaaatcaatgcctttgcatagaaaatcaaattcagggaccacaaagaattttcagtgggaatgtctagtctgaggggtctgaggttgtttttactttattgtgttgtttaaatattttaaaaatatctttagcgtttggtcttttttttttctgtaaacatttaatttggtctgagaaaagctgaatgtttgggtgtgacgtttgactgaggtggattggggctgcctgtggacattagtgaacaggtggtaggcttcaggaatatccagttttaatcagttgcatttggtacagaattttgagtaatggtgaaaattgttgtctttggaaagcacaaaagaaacctggaaaggcagttcggctcaggtagctacacataacattgtgtatgattttcacttcaaagctgtctggaaggaaatgcagtcagctccagctagtactatttatgtacccagataactaagatattgtttcatggccttgccttagtcagaggcccttttctctgtcctgaacccccaggtatgggtgaaattggaaattactaatctattggaaatcagttcctgacatagtaaagtttgctttcataactgcagcaaaaaaggtcaacttgccaagtcactgctgccatgtgtgtactgtattattttcagaaaaaaatataatagtctgagtccaagttatcttgatttaaaattgatagagaaaagaaactgtcgagcaagttatataacaactaacaacattgcactttctgtatatgaaatcaatatttaaataacttatttttctccattgctgttcttaaaaacattgtaagtagctgtaatataccagtaccaatatgttcttgcaattgcttcagcccaagaaagctgtgtattgttttaaaaattgtaaaaattattgtgatgattcatttagcataaagagaggtggacggaagggttttcctatgtatcaaaacttgtctataattatgtcatctatgtacctagaaaaaagtaaataaatttcttcagttgaatatg

SEQ ID NO: 4027 - DNA, 3988 bp, Homo sapiens
tgcaactccgagcgtgagtccaggctaaggggacgccggccggggaagaggcgcggcgggagaagcgaccgcagcgggagcccggccaccgagggctgccggcactaggcgcagagccgccagcgctcggaagcccgcggggtgcgggagcgggaacagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgcttctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatctt

SEQ ID NO: 4028 - DNA, 5582 bp, Homo sapiens
ggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttggggattgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacattaaaaaaaaaaaaaaaaaaaaaaaaaaaa

SEQ ID NO: 4029 - DNA, 1515 bp, Homo sapiens
ccggctccggcgctcacctacccccggcaggccccgcccccgtgcggtccctcccggaagcgccggcggagcgtcctcgcatggagcgcgagcccagcgcctcggaggccgcccccgcggcggccgcgctcttcgcctggggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcgtctccgcattgcttaactggagcaactgaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaaaaaaaaaaaaaaaaaaaaaaa

SEQ ID NO: 4030 - DNA, 7777 bp, Homo sapiens
agtgcgcgccgagcgaagggcggcggcggtggcggcggcggctcgtgctcggccccggctgcgattgcgctcagctccaggttccctgcccgcggcggcgcgcccccagcgctccctgcaccccgcgccacccgcacccgcgctcggcccgctgcgggcggaggagcggccatgccgccgcggcgcagcatcgtggaggtgaaggtgctagacgtgcagaagcggcgggtgcccaacaagcattatgtctacatcatccgggtcacgtggtccagcggctccaccgaggccatttaccggcgctacagcaagttttttgacctccagatgcagatgttggacaaatttcccatggaaggaggacagaaggaccccaagcagcggatcatcccctttctgccaggtaagattctcttcagacgaagccacatccgggacgtggctgtcaaacgcctgataccaattgatgaatactgtaaggccctcatccagctgcccccctacatctctcagtgtgatgaggtgctgcagttctttgagacaagacctgaggacctgaatccccccaaagaggagcacattgggaaaaagaaatctgggggtgaccaaacctcagtggaccccatggtcctggagcagtatgtggtggtagccaactaccagaagcaggagagttcggagatcagcctcagcgtggggcaggtggtggacatcatcgagaagaatgagtcaggttggtggttcgtcagcactgccgaggagcaaggctgggtccctgcaacgtgcctcgaaggccaggatggggtgcaggatgagttttctctgcagcctgaagaagaggagaagtacacagtcatctacccgtacacagctcgggaccaggatgaaatgaacctggagagaggggctgtggtggaggtcatccagaaaaacctggaaggctggtggaagatcaggtaccagggcaaagaaggctgggcccccgcctcctacctaaagaagaacagtggggagcccttgcccccgaagccaggccctggctcaccctcccacccgggtgcccttgacttggatggtgtttcccggcagcagaacgcggtgggcagggagaaggagctgctcagcagccagagggacgggcggtttgaaggccgcccggtgcccgacggtgacgccaagcagagatcaccaaagatgaggcagagaccccctcctcgccgggacatgaccattcctcgaggcctcaacctgccgaagccgcccatcccgccccaagtggaggaagagtattacaccatcgccgaattccagacaaccatcccagacggcatcagcttccaggcaggcctgaaggtcgaggtgatcgagaaaaacttgagtggctggtggtacattcagattgaagataaggaagggtgggccccggccaccttcattgacaagtacaagaagacgagcaacgcgtcgagacccaactttctggctcccctgccccacgaggtgacccagctccggctgggggaagcagcagcgctggagaacaacacgggcagcgaagccacgggcccctcccggcccctgcctgacgcaccgcatggtgtcatggactcggggttgccatggtctaaagactggaagggcagtaaggatgtcctgaggaaggcatcttcagacatgtctgcgtcagcaggctacgaggagatctcagaccccgacatggaggagaagcccagcctccctccgcggaaagaatccatcatcaagtcggagggggagctgctggagcgggagcgggagcggcagaggacggagcagctccggggccccactcccaagcctccgggcgtgattttgccgatgatgccagccaaacacatccctccagcccgggacagcaggaggccagagcccaaacctgacaaaagcagactgttccagctgaaaaatgacatggggctggagtgtggccacaaggtcttggccaaggaagtgaagaagcccaacctccggcccatctccaaatccaaaactgacctgccagaggagaagccagatgccactccccagaatcccttcttgaagtccagacctcaggttaggccaaaaccagctccttcccccaaaacggagccacctcagggcgaagaccaagtcgacatctgcaacctcaggagtaagctcaggcctgccaagtcccaagacaagtccttgttggatggggagggcccccaggcagtagggggccaagacgtggccttcagccgaagcttcctcccaggagaggggcctggccgcgcccaggacaggacgggcaaacaggatggtctcagcccaaaagagatttcctgcagagcccctccgaggccagccaagaccacagatcctgtgtctaagagcgtgcctgttcctctccaagaggctccccagcagagacctgtggtcccaccccgcagaccacctcccccaaagaaaacctcttcgtcatccaggccgctcccagaggtcagaggtccacagtgtgaaggccacgaaagcagggcagctcccaccccaggccgtgctctcctcgtccctccaaaagccaaaccttttctctccaactctttggggggccaggatgacacgcgaggcaaaggcagcctggggccatgggggaccggcaagattggagaaaacagggagaaagcagctgcagcctctgtccccaatgccgacggcctgaaggactctttgtatgtggccgtggccgactttgaaggagacaaagacaccagcagcttccaggaagggacagtgtttgaagtccgggagaagaacagcagtggctggtggttctgccaggtcctgagcggagccccttcctgggaagggtggattccttccaactatctcagaaagaagccgtagccgactccctttctgcctagagggcccgctggtccttgctggctttacccacgtatttaatacgcctcttaatttatcattctccacgcagcttccaaggcagacagactctggggtactgtgacttcttgcctcccatgggtggagagtgagtttcggacacctcgggcgcccctgggcctgatccctcctatcacagcatcactggaggctcagaacccacagcctttgctttctgtccatgtcagcatccctgccttaagagaactcctcctggccaatggcattgccacccagcagtgggaccaagactctccaagacctccaggactggatcccattgcctggagaaactccagcaagggtctctcatggcttggacatggcacagtaaggggcagccaacccagtccatgatgacttttgctccaacttcttcatgtttctaaaagcccagtggctttattcactcctcctaaattgcctgctaccagaaggaacttcatcctgaagaaatgcattccattaccagttccagggaaagtgtccccttccccaaagcctcaggcccgtgggcctctgaggttccactggatgcggctcccccaggagtgggcctggagatccgctcagccgccctgcctcccaccttctatcttgggaccgtggtcagccctgaagggtggttccagccccgcgtatgctgcgctttgctgctgcaggctccggtccctccagggcttttcaatgagagttcccaccccaacttggagcatttcatttttgcctacctaaagcaagaatctcaaagtttgtttgaataagaggcccattcacaagtcgtgcccttgtgagcacccctttgctgagtgcctcgtgggtgccaaacactgtacttggcgctttgcattcatgctttgaccctcacaacctccctttatagatgaggaaattcacgctccatgtgcccaaggacacaccagccaggaggaagagggaagaggatttgagtccaggcctgcctgacttcagtgcctgtgccctcccctctgtaaaagacaaaccaggcagggaagagatagaagctggctaagtggtggccaagtggcttcattgtgaggggggtgagggggcattcgtggctgctcccacacccaccatccctccagcccacagcagcctataccaaaggctgccctggactcaacagctgcatctccatgacaggagaatgccagggtcctggtggttgacacagagccctgttccctcttctaagctgttgccccctggggaatagagcttatggagcaacgggagctgaggtggcctcgagggccagcctggagggctctgagcatagcatgcagcggtcccatagggaggcaggtaaccaagggccaggcagagctgcttcctgtgcctctccggcatttgtaatgtttttttcttttttcacgcactgccaaatctgttttctcccttgaagaaacccagggcagatgtggtcatctgtcaaactgaggtctggagaggcatgactaaatcactgcagaagcaaaatcaggacccagcatttctagctcccagcccagagtaagagagcagagcagaaccccttcccattctacccgaccgaggcagccctgccctgccctgccccgcccctccccaccctgccctgccccagagatctccagttcacagtgttcatcaggcgagatacttttggacccacaaagccagttttttggggggatgctcagtgtctacctgcagtgccaaagttttgcttgaacagccctcttctgccgcgcctcccagctccaccccctatcacgtgggtgctggctgcttctgcgtgaggagcttcctctgatcacctgtagcatctttagtgccttcgtccagtcggcctgcaaatcccatttcccagagaggcttgggcagggcccacttgccacttggccctgtgcccagagcgttgggggcagatggcagccaggggaagaagggaggtggggaagggccgccaccgcttgagggtcccctcccttgagaggaggccccatggcagttttcctgagttcttgatccactttggtttaaacaacttttgtgaagctatgtgagatttgactgcatttcaaaagacaaaacacatgtttttttctgatttgctctttgcctttcagcgacgctttcagatactttgtgagtgtctactctgtgctaggtgctgagtagactgggatgtgtgtggctccatccctggctggaagagctttgagtcctgtctgctgacttcactgaaggagtttctctcttgcttcattccttcctcccgggggtcagctgggtaggagcagacttgccctgccttcctctaggcagaaagttttcctgcaaatgaaagaatctgccattctcttttgctatgatgatgatgattattctgacatgacccgcgggtactgaagccacagtcctctctgttcactgttctctccttgagtcatatctatggcctgaggacgtctgtatccagctccttttcctacaatggtagacacttccccaggcagtgggtgggtcagggtggccagtcactctcctagctgtccttgcctggggacttagatttaccccatccaggactgtggtcgctattctgtgagcgattgatggcgcatatgcagaactcccctggagtcatggctctagaaagtgtccaggcccatcgtgacaatggtgccaagcaccgggctggtgaccagtgcctaaacacacacgctcctttaatccttacggcaagcctgtgaggcggataggaccagccctgatctatagtgagaaaattaaggttcagagggagaaggtccaaatagtggccaagctgggactgagatctcgagtttgggtttgtttggttttgttgttgttgttctttccctcgtgtccatgacttttctctgccattagcagggaagtgtgcggagggcttccagggaatcaagtgaccctccctctgaatttcggtgcctcttccccccgccccttgctcacacatttcagtaggtcacaggccaaatggcagcccaaaaggtgggcagagatttttttttcttcccctcacccctgcttattaacacaattgtgacaactactttaccttacatcccagggcaaacggacagcttgcggtacctccaaaaatttggaaaaccctgagtctaagaccacctcttgataaaagaggcctttgctcacatgttctgctcggaatctttctttgccattggtgggtgtatgtcgtcccagctgagactgcgggagagctgagctccagcttaaaccgcttttaatggcccttccctactgggggatcgctggagcccatgccaggttacggtagtcattttaaacctctgccacaaggccacgccatagaatcaatttccaagtcaatgttcttggccctaaaatgtttgcgcccactgaggatttcattaccaggtggaagatgggggaacatatgccacgttaaagagcaagtgctgagtgtgccaggacttgagaaggaccttaggctgaggagtggacagtctggtatttatttcgcctctcccaagtacccagcacagagtgggaaaaagaagaaactgctcctgccttccagtagctggcaacttgacatcaagaacaaaaacattcgtagctggacccccgtcctttcatcgtgcccaagtcttacatgttggcttaagctgcccccttggaggccgtacctttctctttggactgtgacagtggacacctaacagcctgagccatgtgtggctgtcttatcccccaagggttgtccaggcccgttctgcagggctgttgtgtagactgcagacatccatacctcaccacagaccaaagatgacctcgtgtcagactgtgggctgatgagaggtagagcagcatgcatcgaggcctgagggtgcagggcgccctctcttggcctggaggaattgctcctaactagagtaagtttccacgagggtcccaggcagagctgcagagctggaaccggaggctccacagtccttgcctgctcatggacctccttcagagcacctttctacagactggactgcccagctccgtggggtggcatctggtttctggtgctattctgccaagttatcgagctcctcctcatgtttcaacattccatcttcccgtttctatcctcgactccaaagtaagccttcttagctccaatcagggatgaggggctcaacctcttctgtcctcaaagaggccaaacgcagtgccacagtcggtagccttcacttttagatgtcctattcatgtaaaaaagaaggtgcccccaccaggcttacatcagcaataagcaattctaatgcaacgatggtgtccacattttaccccagtgtgtgcccatgtatgcctttgtgcccgtgtaattattgttagcgcccctttcacttagaggggtgatgataaactgtggccaccttgattacaacccacatttcctgctttggggagcttccaagtaacaggccatttcttacctccctccaggaacagtgggcactgcccaccacctcgtgtctgctcataggatgacgctggagatccccacacttactctaccctcttggcaaattggcattccggtggtggtttttgtttcctttaacacattaaataaatgagtatataggatgtgaggggaggggtgagaacaactagctgtagcatgtgtaggctatatactttaccatttgacttctttcctttttttttttttaaataaaaaaagtgcttgactggtttcaagcttcatcatgaa

SEQ ID NO: 4031 - DNA, 5239 bp, Homo sapiens
agccatgcccacgaactttacggtggtgcccgtggaggctcacgccgacggcggcggggacgagactgccgagcggacggaggctccgggcacccccgagggccccgagcccgagcgccccagcccgggagatggaaatccaagagaaaacagcccattcctcaacaatgtcgaggtggaacaagagagcttctttgaagggaagaacatggcacttttcgaggaggagatggacagtaaccccatggtgtcctcgctgctcaacaagctggccaactacaccaacctgagccagggcgtggtggagcacgaggaggacgaggagagccggcggcgggaggccaaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacgtacatctccccgggtgcggccatcttccaggcggaggctgcaggtggcgaggcggccgccatgctgcacaacatgcgtgtgtacggcacgtgcacgctcgtgctcatggccctggtggtcttcgtgggcgtcaagtatgtcaacaagctggcgctggtcttcctggcctgcgtcgtgctgtccatcctggccatctatgccggcgtcatcaagtctgccttcgaccccccggacatcccggtctgcctcctggggaaccgcacgctgtcacggcgcagcttcgatgcctgcgtcaaggcctacggcatccacaacaactcagccacctccgcgctctggggcctcttctgcaacggctcccagcccagcgccgcctgtgacgagtacttcatccagaacaacgtcaccgaaatccagggcatcccgggcgcggccagtggtgtcttcctggagaacctgtggagtacgtacgcgcacgcgggggcgtttgtggagaagaaaggtgtgccctcggtgcccgtggcagaggagagccgtgccagcacactgccctacgtgctcaccgacatcgcggcctccttcaccctgctggttggcatctacttcccttccgtgaccggtatcatggcgggttcaaaccggtccggggacctcaaggatgcacagaagtccatccccacggggaccatcctggccatagtgacgacgtctttcatctatctctcctgcattgtgctgtttggggcctgcattgaaggcgtggtcttacgagataagttcggggaggccctgcaggggaacctggtcatcggcatgctggcctggccctccccctgggtcatcgtcatcggctccttcttctccacctgcggtgccggcctgcagaccctcacgggggcaccgcgcctactgcaggccattgcccgtgacggcatcgtccccttcctgcaggtgtttggccacgggaaggccaacggggagcccacgtgggcgctgctgctgacagtcctcatctgcgagactggcatcctcatcgcctctctggacagcgtggccccgatcctctccatgttcttcctcatgtgctacctgttcgtgaacctggcctgcgccgtgcagaccctgctacgtacccccaactggcgtccacgcttcaagttctaccactggaccctgtcctttctgggtatgagcctgtgcctggcgctgatgttcatctgctcctggtactacgcgctgtccgccatgctcatcgctggctgcatctacaagtacatcgagtaccgcggggccgagaaggagtggggcgatggcatccgtggcctatccctgaacgccgcccgctacgccctgctgcgcgtggagcacggtcccccccacaccaagaactggaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtagacaccgtccgcgacaccaccgccgcgcaccaggctctgctggtggccaagaacgtcgactcgtttccgcaaaaccaggagcgcttcggcgggggccacatcgacgtgtggtggatcgtgcacgacggcggcatgctcatgctgctgcccttcctgctgcgccagcacaaggtgtggaggaagtgccggatgcgtatcttcaccgtggcccaggtggacgacaacagcatccagatgaagaaggacctgcagatgttcttgtatcacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgacaggaacaccgcgtcccacaccgcggcggcagccaggacccaagcgccgcctacgccagacaaggtgcagatgacctggaccagggagaagctgatcgctgagaagtacaggagcagagacaccagcctatccggtttcaaagacctcttcagcatgaagccggaccagtccaacgtcaggcggatgcacacggctgtgaagctcaatggcgtcgtcctcaacaagtcccaggatgcgcagctggtcctgctcaacatgccaggtcctcccaaaaaccggcagggagacgagaactacatggagtttcttgaagtcctgaccgaggggctgaacagagtcctcctggtcaggggtggcggccgggaggtgatcaccatctactcctaatgcccaacagcatcacggcactctgggacaggcacggaggacggcgtgggcagcctgggcctgggcttggcccagggaaccagacggcagacacacctgtcccccagtgatgccacccaagctgcccatggggcttcctacggaagtttctaggcccgtcacctagggctctcctgttcagccttaacaggctcagcaaatcagggcgtggctggacgatttccttgcatctgagggcagacgctgctaccggagtgacctggacgtggccagatcttctcgcaggtcacaagaagccagtgagcccttgccttggtttctggaagttcttttccttggctggatttacccagtggttaggttgcatttctaccccatccagaacattcttggaagagcacccggagctgaagctgtccctgatgatgaaggtgaaacgtcagccctggccatggctccgctcagggccccggtcacctccgagtcactctgttccttgactgtctttgtgtttctgtacctcaaggcactgaagctggaggactctgtccatgcccgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccagctgtggctctgccatgccgggctgtgtttgcagctgtccgagtctccatccacctttagaaaaccagtcacttcttttcataagcactgacagggcccagcccacagccacaggtgcgatcagtgcctcacgcaggcaaatgcactgaaacccaggggcacacgcgcgcagagtgaacagtgagttcccccgacagcccacgacagccaggactgccctccccaccccaccccaccccaggagcacggcacacagttcagcctctgagctggctcacacgtgccatccccaccccggtgctccagggaaggaggacacggacccgacgtgggaggtcctcaggcagcagtggcgcctggtgtcaggtctgtctggctgagtcccgggcgtcccctgccatggcctgtgccttgcatggaggcggcggtggcactgaagagatagctttcaagggcccaacactttgcacttcggctggctgtgagtttctgctttgtaggttgtggtcacatttgcaggctgcgggcagtggcaccgacttgggcctccctttctatgtggcatatttatttatttaaacaccccagggagttacgtggtaacaaggttgtccataaagaggttgcttctatatactagaggccccagatggcaggccttgggctacgtctggcttgcatggtctcccaagggaatcaaccccatcaacaaagttcaaatcggggcagaggctgcacttgtgcccccagatgtttctgaggagccagattagggctggcattgctgtagagtgacggctgctgcccagagcgtgtcccagacatcacagcggggctcagcagttcccacagcctctgcctgccttggctaagcatgagttaagcagcaaaacgctcctccatgtctggatggggccggcaggtcctgtgtcccctgcacctggaggagagcaggctagaggcacagcggccacatggtgctggctctgaacgttggttggtggctggaaaacagccctgcttctgagggccgctcagttctgcacacgaaaccacctcctgagggctcagctctgcccccgccctgggctgcagcctctgcacgcaagcaccaggcatcctttgtgttgtcaactccgtgtaaccagtaactacagccatttacaattgactccgtttccttttgtaggtttccctgtctgtctgtgttagtagaaaaataaaatcctatgaaatctgaaaaaaaaa

SEQ ID NO: 4032 - DNA, 3475 bp, Homo sapiens
agagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggattccctgtacctcaacacccagaccctgcctccctcaggcaccagatccagtgtcctagtgaaacgctggatcctagatccccaaccccagatccccatgcctcgagccctggatctccaagctcagctgctggattctggatgtcaacaaacctcaccactggatcctgacaaccacaatgcctggatcctggggcccccatcactggatcccagatcccctcactccacccactggattcctgcattggtttttggttttttgtttttttttaacctcgacactgggtctcagatccttctgctgactgccagatccctgcatttcaagcactacgccttccacccccaggcactggatcccagattcccaagccttcacccaccagattctggctcctaaaacaagtgcgggggccccagtggcacagcaagtggatcctggcaactgcagctgctggattccagattctgggtccccaatccctctgcccagtccctcaatgttgaaacctcatctcttgaaggcagatcctgatattccaaggcactgaatcccaagccctgaatccccggtttctgatctgaatcttccaggcgccgggtcccaaatgttcaggccccaagtctagatcctggcagcccagtcacagagtatcccacacacactggtgcccagagccggcttctcatgacatgaaattgcatggtcgagggagtctgtggggaaggaagcccaggtcctggctgcaacctgcacggatgctggattccccctcaccccacctctgcatggccaccccctcccagccctgtggggaaactgttccctggaaccactccactccctgcatccccacacttcacagcatcttccatccccctcccaccttctaggcgaatagtccccagagctgtgttcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctctttaaaaaaaaaaaaaaa

SEQ ID NO: 4033 - DNA, 1698 bp, Homo sapiens
tcggcacaggagcgaggagacccgagagcagacgcgccctggcgcccgccctgcgcagtcaccatggcgatgcatttcatcttctcagatacagcggtgcttctgtttgatttctggagtgtccacagtcctgctggcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtggtacttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagatggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacgtagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgattgactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatgggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaatacattttagtaaatat

SEQ ID NO: 4034 - DNA, 2676 bp, Homo sapiens
gcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagcaaaaaaaaaaaaaaaaaaa

SEQ ID NO: 4035 - DNA, 4493 bp, Homo sapiens
agcgggaggggttgcgggtgagctgcgctgagcccaggagccgaggagtcgggagcgcagcgcagcccgagcccgagcccgagcggccccgcgtcccgagcgcatcggagcggccgagccgcccggcgcagcgcctggcccgggcagcgcagccccggccgcaggatctcaccaaaggtggcagaaggaggccttctggagctgacccacccccgacgaccatcagggtgaggcaactccaaggtcctactctctttctgtgcctgttacccaccccgtcctcctagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggcagacctccccgaccgggacacgtggaagggccgcttcgacttcctcatgtcctgtgtgggctatgccatcggcctgggcaacgtctggaggttcccctatctctgcgggaaaaatggtgggggagccttcctgatcccctatttcctgacactcatctttgcgggggtcccactcttcctgctggagtgctccctgggccagtacacctccatcggggggctaggggtatggaagctggctcctatgttcaagggcgtgggccttgcggctgctgtgctatcattctggctgaacatctactacatcgtcatcatctcctgggccatttactacctgtacaactccttcaccacgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcacgaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgcaactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagccccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatccacagtaatctttcggtctccttaaactaccaccctcgctgccacccaccccaagctgctgccgcctcaccttccttgaaatttctcagcgggagtctcctcactgccactaaaacccacccagcccactaactgaggagctagtgttaatccagagaaccccccgcaatgtgcttccgagattcagactgcttcattgggaagtatgatttgttcctttctggaattgggctccgtggtggcggcggcacttcaagcaaagacagtttcttgcaagctccagtagctccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagaaaaaaaaatatgtgtacacatatgaacgcacaacatgcacattcatcatcacatgtggcacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgctttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaacaaaaaaaaaaaaaagaaaaaaaaaaaaaaaa

SEQ ID NO: 4036 - DNA, 9648 bp, Homo sapiens
ggtttgtaatgatagggcggcagcagcagcagcagcagcagtggtggaacgaggaggtggagaattgagagcacgatgcatacacaggtgtttctgagtagtaattagatcgctgtgaaggaaaaagcacacctttgagttttcacctgtgaacactatagcgctgagagagacagtctgaaagcagaggaagacatcgatcagtaacaccaagagacaccaaagttgaaagttttgttttctttccctctgttttatttttcccccgtgtgtccctactatggtcagaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccagaacacgggcagcgtgggcatgtctctgaccatctggacggtgtgtggggtcctgtcactatttggagctttgtcttatgctgaattgggaacaactataaagaaatctggaggtcattacacatatattttggaagtctttggtccattaccagcttttgtacgagtctgggtggaactcctcataatacgccctgcagctactgctgtgatatccctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcagagaaaataaccagaacattacaaataatactggaagttgtaccagaagaagataagttatgaactaatggacttgagatcttggcaatctgcccaaggggagacacaaaatagggatttttacttcattttctgaaagtctagagaattacaactttggtgataaacaaaaggagtcagttatttttattcatatattttagcatattcgaactaatttctaagaaatttagttataactctatgtagttatagaaagtgaatatgcagttattctatgagtcgcacaattcttgagtctctgatacctacctattggggttaggagaaaagactagacaattactatgtggtcattctctacaacatatgttagcacggcaaagaaccttcaaattgaagactgagatttttctgtatatatgggttttgtaaagatggttttacacactatagatgtctatactgtgaaaagtgttttcaattctgaaaaaaagcatacatcatgattatggcaaagaggagagaaagaaatttattttacattgacattgcattgcttccccttagataccaatttagataacaaacactcatgctttaatggattatacccagagcactttgaacaaaggtcagtggggattgttgaatacattaaagaagagtttctaggggctactgtttatgagacacatccaggagttatgtttaagtaaaaatccttgagaatttattatgtcagatgttttttcattcattatcaggaagttttagttatctgtcatttttttttttcacatcagtttgatcaggaaagtgtataacacatcttagagcaagagttagtttggtattaaatcctcattagaacaaccacctgtttcactaataacttacccctgatgagtctatctaaacatatgcattttaagccttcaaattacattatcaacatgagagaaatcaccaacaaagaagatgttcaaaataatagtcccatatctgtaatcatatctacatgcaatgttagtaattctgaagttttttaaatttatggctatttttacacgatgatgaattttgacagtttgtgcattttctttatacattttatattcttctgttaaaatatctcttcagatgaaactgtccagattaattaggaaaaggcatatattaacataaaaattgcaaaagaaatgtcgctgtaaataagatttacaactgatgtttctagaaaatttccacttctatatctaggctttgtcagtaatttccacaccttaattatcattcaacttgcaaaagagacaactgataagaagaaaattgaaatgagaatctgtggataagtgtttgtgttcagaagatgttgttttgccagtattagaaaatactgtgagccgggcatggtggcttacatctgtaatcccagcactttgggaggctgagggggtggatcacctgaggtcgggagttctagaccagcctgaccaacatggagaaaccccatctctactaaaaatacaaaattagctgggcatggtggcacatgctggtaatctcagctattgaggaggctgaggcaggagaattgcttgaacccgggaggcggaggttgcagtgagccaagattgcaccactgtactccagcctgggtgacaaagtcagactccatctccaaaaaaaaaagattatatatatatatatatgtgtgtgtatgtgtgtgtgtgtgtgtgtgtgtatatatatatatatatatatacacacacacacacacactttttatatatatatatatatatatatagtggaacttacaaatgagagtaatataatgatgaaattttgaactgttatttataaacatctaaggtaaaatggttagtcatggccagagtatgtttcatcctttaatttttgtccatttgaaaataaggatttttgaaagaattataccaattaaaattattaaaggcaaacatagaattcataaaaaattgtccaaagtagaaatgatgacctataatttggagcatttccaattcagtaatttcaattttgctcttgaaaacatttaatatatatccaagactgacatttctttagctgaacctaacgtttgggtctctgagtgaatttataataactccttccttccttagcatagggttttcaaaatttgatttataattcctatttccagtaaatattgttcatttgtccacatctctccctatgatatgttgctggaggtaagaatttctttcatattcctattttttttttccccatagactaggctcatagaatttaaacaagcaaattttcctgagctttttcttgccaaatgaaagaagactggtaaattctcatagagaggtttgtgtagttcttggctcttcctggggttaatgtgcttatattcacagtggcaaattggtctcagactttaatttatttatttttgatttgaatttctctttaaaagtatcaatttaaaaggtaactagaattattctttctcattttcaaaagtgatttttgcattattaaatttccctgccattgtaatgccatttcacgcagaaaaaaagtcagccagtaattaagaaaaaaagtgatggagattaagtagtattttggcttatttttaggactcatcatgagaagacacagttcctttaatcaggaaattaatatccataattttcactcaaaattgcagtatgtaaagcagattctcaaaaactctcctgaacacttatttatatatatgtttttatataagtaaaatttttctcatatttttatacgatatgcacacacacacatacatgcacatactacttactacatgttctgtacttgtactttgtaccatgcatattcaaatgtttatatacataagtttattataacataaacagtaaaagtaatgaatactgtttaaaataactaatatagtattttttaatttttgtggggatggattctcaaatacttgtgattttaaaagattctaaagctaaaacacaacttgattttaaaaagaatgattctccttacacaattataaatatttgcagtaaatattttccttataatactgttttgaccccatttaaaaagtattagattatattcctttgatccaatgaaaactgaaccttataaatggttagctgaaagtagaccttattcttgtccttctttagaagagtaaagatttgtcctagggaagatggctgacttcggttcccaacatgcgtatgcatttagactgtagctcctcagccctgtggacacaaaatttggacagcttattaggttacgttagcaatgcatgacggtttctccaacactaagatattcacgttgaaacagatttcctgttcgtcttatgtgtctggtaaaattgtttccccaattacaatttgacatatcaatagagggttaacaagagtataattacataacagaattcctcatgaactgtaatcagtctacaggaaaatcattattttatcttgatttgcagatgaatatactgctaagaaagggagcaactctgacctttgttaaagttgatcttttgtaattgaggtataaggtatgaaaagataaaaaaccgaaggccagagaatcaggaaatgaaagatagtatggactgaaggtaacaatattttaatgttatgcaatatagtcagagaaatattaaaaattagttgtttgctgtgcataggtggatctcgcaggaagctaatgaaacctaagcttcagtgcctctcacttagacatgttccattcgaggtcctgaacctaactttgtattaggaattctgtactaattttgttgaagaagaccagcaaagttgtgtacacttctacccccacaaaatctgcattgtccatgtgagtaaagtaaaataattcctgttatttttttctgttagaaataagtatggaggatatgtttttaaaaatttatgagttaattgaaatatccatatataacaagtgactttctcacaatatatatgatgtgatatatagggagatagtttcactttcatcatattttatacgttgattctgaactatagaaaaataataaatgggattttaattatagctcttagttgggaaagaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggtggctcatgcctgtaatcccagcactttgggaggctgaggcgggcgaatcacctgaggtcaggagttcgagatcagcctggccaacatggtgaaaccctgtctcaactaaaaatataaaaattagccgggcgtggtggcaggcgcctgtaatcccagctactcgggaggctgaggcaggagaatcacttgaacccaaggggcagaagctgcagttagccaagatcgcatcattgcactccagcctaggggacaagagcgcgagacttcatctcaaaaaaaaaaaaaaaaaaaaaaaaagatttttaaataatagctaaaggtatgctctctaggtcatccttagtttattagtactgtacttaaaaattattttttaatagtcaattttgggagataattatttctttccttatattttccaattagttggtgtctaaaaataaatgttttgtctaattttagatcaggtatacattcacaaaagcataaatcatagtctcacaggaaattcaccaattttccatatgtcgtgagataactgtcctttctacaacctcataacaatgaatttatataattacctagattttcttagtgtgaatctacccattagttttattttcttggtagttatttttttccctcctctctgttactattggccttaaaatacacagaggacggttacagtgtcctaatagctgttacatgtgtgtgtttcagcgtacttgaatcaagtgtacatttatagtaccaataaccgcctttacagctttacagttaacaattctctcacaaaactgtagagcattaggcatctgagagccatagagggccaactttgttccagagtgaacatgctttttttcctcaacatatacactactgattttttttaaaagtatgactttcaagtgaattaatgtattggttaggagaactgcttgctaagtccttattacctcttgttaaagcctcagaaggccgtgctgaaagccagaggggaaaaaaagagtaatgcacaggtatctcttttgcagtggtgactgtattttgagtaccttgtgtgacagggtattattacagcatcttgtgggaaaacctattaggcctttgcatgttaaagctgtataatttgttgggttgtgagtggtctgacttaaatgtgtattataaaatttagacatcaaattttcctactaactaactttattagatgcatacttggaagcacagtcatatcacactgggaggcaatgcaatgtggttacctggtcctaggtttgaactgtcttatttcaaaagatttctgaattaatttttccctagaatttctccttcattccaaagtacaaacatactttgaagaatgaaacagattgttcccatgaatgtatgctcatactcgactagaaacgatctatgttaaatgactgtgtatatgaattatttcaagtactaccccaaataactttcttattgctctgaaagaagaaaagcaatgtaaatcactatgattattgcacaaacaaccagaattctccaacaattttaagtaatctgatcctcttcttggagaaaattgttacctaatagtttttccttatgaatgttattactactggtataaatcaaatttctataaatttcctacttaagtcttaagaactgggttcttcctttgatgttattcatgttcagaaaggaaacaacactttactcttttaggacaattcctagaatctatagtagtatcaggatatattttgctttaaaatatattttggttattttgaatacagacattggctccaaattttcatctttgcacaatagtatgacttttcactagaacttctcaacatttgggaactttgcaaatatgagcatcatatgtgttaaggctgtatcatttaatgctatgagatacattgttttctccctatgccaaacaggtgaacaaacgtagttgttttttactgatactaaatgttggctacctgtgattttatagtatgcacatgtcagaaaaaggcaagacaaatggcctcttgtactgaatacttcggcaaacttattgggtcttcattttctgacagacaggatttgactcaatatttgtagagcttgcgtagaatggattacatggtagtgatgcactggtagaaatggtttttagttattgactcagaattcatctcaggatgaatcttttatgtctttttattgtaagcatatctgaatttactttataaagatggttttagaaagctttgtctaaaaatttggcctaggaatggtaacttcattttcagttgccaaggggtagaaaaataatatgtgtgttgttatgtttatgttaacatattattaggtactatctatgaatgtatttaaatatttttcatattctgtgacaagcatttataatttgcaacaagtggagtccatttagcccagtgggaaagtcttggaactcaggttacccttgaaggatatgctggcagccatctctttgatctgtgcttaaactgtaatttatagaccagctaaatccctaacttggatctggaatgcattagttatgaccttgtaccattcccagaatttcaggggcatcgtgggtttggtctagtgattgaaaacacaagaacagagagatccagctgaaaaagagtgatcctcaatatcctaactaactggtcctcaactcaagcagagtttcttcactctggcactgtgatcatgaaacttagtagaggggattgtgtgtattttatacaaatttaatacaatgtcttacattgataaaattcttaaagagcaaaactgcattttatttctgcatccacattccaatcatattagaactaagatatttatctatgaagatataaatggtgcagagagactttcatctgtggattgcgttgtttcttagggttcctagcactgatgcctgcacaagcatgtgatatgtgaaataaaatggattcttctatagctaaatgagttccctctggggagagttctggtactgcaatcacaatgccagatggtgtttatgggctatttgtgtaagtaagtggtaagatgctatgaagtaagtgtgtttgttttcatcttatggaaactcttgatgcatgtgcttttgtatggaataaattttggtgcaatatgatgtcattcaactttgcattgaattgaattttggttgtatttatatgtattatacctgtcacgcttctagttgcttcaaccattttataaccatttttgtacatattttacttgaaaatattttaaatggaaatttaaataaacatttgatagtttacataataa

SEQ ID NO: 4037 - DNA, 4108 bp, Homo sapiens
gtgacccagggagacaaacacttggagatacttggggctgagtttgagcaagactccctaacctgtgtctggacaggtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcataaaaaaaaaaaaaaaaaaaaaaaaaaaaaaaaaaaaaaaaaa

SEQ ID NO: 4038 - DNA, 4950 bp, Homo sapiens
cagagcagggtggagagggcggtgggaggcgtgtgcctgagtgggctctactgccttgttccatattattttgtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcagctaaagaacagtatttcattccaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcacgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccatgtgggactaatgaatgcttcatagtggaaatatttgaaatatattgtaaaatacagaacagacttatttttattatgagaataaagactttttttctgcatttg

SEQ ID NO: 4039 - DNA, 4110 bp, Homo sapiens
gcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctggaagtgtaaaaaaaaaaaaaaaaaa

SEQ ID NO: 4040 - DNA, 3497 bp, Homo sapiens
gcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggaaattgaagctcaagaaggtgaagatgatacctttctaacagcccaagatggtgaggaagaagaaaatgagaaagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctggaagtgtaaaaaaaaaaaaaaaaaa

SEQ ID NO: 4041 - DNA, 4164 bp, Homo sapiens
gcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctggaagtgtaaaaaaaaaaaaaaaaaa

SEQ ID NO: 4042 - DNA, 1943 bp, Homo sapiens
gcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaaccctacagtttaaatgatgtcacttttagtgctgttggcaagaaaaaaaaaaaaaaaaaccaaaaaaaaaaaaaaaaaa

SEQ ID NO: 4043 - DNA, 3350 bp, Homo sapiens
gcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacaggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtgattgagtctcatagtctttcatttgctagctgtgatccaaattttattagaacataagtcacttgttattgccatttttaaaagagaaaattcataatgatgttatggcaaacagataagactgataaacttcgtattgtatagctttgaaaataattatgcctagtatggagaaacaggaataagatctgattttcttagagttaatatattttagtagattggttttccttttttttattttgtacatagttaactgtgtatctataaataaagcatcctatatgagtttttaataataaaaaaa

SEQ ID NO: 4044 - DNA, 3509 bp, Homo sapiens
gcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtgattgagtctcatagtctttcatttgctagctgtgatccaaattttattagaacataagtcacttgttattgccatttttaaaagagaaaattcataatgatgttatggcaaacagataagactgataaacttcgtattgtatagctttgaaaataattatgcctagtatggagaaacaggaataagatctgattttcttagagttaatatattttagtagattggttttccttttttttattttgtacatagttaactgtgtatctataaataaagcatcctatatgagtttttaataataaaaaaa

SEQ ID NO: 4045 - DNA, 3105 bp, Homo sapiens
ggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggattacaggctctgggaaccacccttctactttctgtctctaggaatttcactactctagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaagggaaattattgtctctaaaaaaaaaaaaaaaaa

SEQ ID NO: 4046 - DNA, 2983 bp, Homo sapiens
ggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcaggctctgggaaccacccttctactttctgtctctaggaatttcactactctagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaagggaaattattgtctctaaaaaaaaaaaaaaaaa

SEQ ID NO: 4047 - DNA, 2931 bp, Homo sapiens
ggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaagggaaattattgtctctaaaaaaaaaaaaaaaaa

SEQ ID NO: 4048 - DNA, 2982 bp, Homo sapiens
ggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaagggaaattattgtctctaaaaaaaaaaaaaaaaa

SEQ ID NO: 4049 - DNA, 3034 bp, Homo sapiens
ggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcaggctctgggaaccacccttctactttctgtctctaggaatttcactactctagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaagggaaattattgtctctaaaaaaaaaaaaaaaaa

SEQ ID NO: 4050 - DNA, 3053 bp, Homo sapiens
ggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggattacagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaagggaaattattgtctctaaaaaaaaaaaaaaaaa

SEQ ID NO: 4051 - DNA, 3440 bp, Homo sapiens
gagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggagcatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaaaaaa

SEQ ID NO: 4052 - DNA, 3347 bp, Homo sapiens
gagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggagcatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaaaaaa

SEQ ID NO: 4053 - DNA, 2808 bp, Homo sapiens
gtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggtcccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcatatttggttaaaaaaaaaaaaaaaaaaaa

SEQ ID NO: 4054 - DNA, 2604 bp, Homo sapiens
atggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagtagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcataaaaaaaaaaaaaaaaaa

SEQ ID NO: 4055 - DNA, 2825 bp, Homo sapiens
gtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaaccaaaaaaa

SEQ ID NO: 4056 - DNA, 5166 bp, Homo sapiens
ccggacccaagtctgcagcggcgccattggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactattggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgt

SEQ ID NO: 4057 - DNA, 2881 bp, Homo sapiens
gtcgacccacgcgtccggagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgtaaaaaaaaaaaaaaaaaaaaaaa

SEQ ID NO: 4058 - DNA, 1792 bp, Homo sapiens
gtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcttccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcaaaaaaaaaaaaaaaaaaa

SEQ ID NO: 4059 - DNA, 3773 bp, Homo sapiens
ctgacgcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccagggggaaaaaaaaa

SEQ ID NO: 4060 - DNA, 3899 bp, Homo sapiens
ctgacgcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggttctactcacattcttactcccaccaaatttctcatggacctgagacaccccgacttcagggagtcctctagggtatcttttgaggatcaggctccaacaatggagtgagagccaaagaaacaaagatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccagggggaaaaaaaaa

SEQ ID NO: 4061 - DNA, 5733 bp, Homo sapiens
aattataacagctggccttctggtgggcaaaccatcccctgatggactggaagcctaccccccaccccaagccctggctgcgacagctctggaaccctgactgcctgggtgcccctcagctctggaaccctgactgcctggatgctcctcagctctggaaccctgactgcttggataccccctcagctctggaaccctgactgcctggaaccgtgatccggaacccaagatcctttcaaggcctcaggggtattgctgctgccctcctccttctcaatttaaccccgcgtccagccgtcgccaccaggggcgtcagagcgcgcgcatgctcctagctcggagccgcgccgatctcgcgccggcacctggcagccaatcgcaggtctccactggacgcgcgcgtgtggaggcgtgcgcgtcggcggcgccgggggcctgaggaggcgtagtcgccgccggctgtgccccgggagcgcctccggggctggtgcgtggccggcagctcgcgaacagcagctgatccggactggatgtgaccttctgcctggaatagctcaagttcttaaaagttgcgttgtaataaacctgaggctgggaagttcaagatcaagatgctggacgatttggttccttagtgaaggctctcttcctggctggtggatgacagccttcttgctgtgttctcacatgacagaaagaggaagcaaggtggcagtttatataaaggaagcattgggacttgtggccccaccattcaggaataaaaaaattagaaaatggaacaatcatgtgaggaagagaaagagcctgaaccacagaagaacatacaagaaaccaaacaagtagatgacgaagatgctgagctcatctttgttggtgtggaacatgtaaatgaagatgctgagctaatctttgttggggtgacttcaaattcaaaaccagtcgtttcaaacattttgaacagagtcaccccgggttcatggtcaaggagaaaaaagtatgatcaccttagaaaagatactgctcgcaaattgcagcctaaaagtcatgagaccgttacatcagaagcagtgaccgtcctgccagcttcccaacttgaatcgagatcaacagatagtcctattattattgagcctttgtctaaacctgattatagaaatagttcaccacaagttgtgcctaataactcttcagaattaccttctcctttgattacattcacagattcattgcatcatccagtaagtacagcactttcagtaggaggtataaatgaaagtcctcgtgtatcaaagcaactttccactttcgaagtaaacagcataaatcccaaaagggctaaactcagggatggaattatagaaggaaattcttcagcttcgttcccttcagatacctttcatacaatgaatactcagcaaagtacaccctcaaataatgttcatacctcattaagccatgttcagaatggagcaccttttccagcagcttttccaaaggacaatatccatttcaagcctataaatacaaatcttgatagggaaaatgaattggcaaaaacagacattttgagtctaacaagtcaaaacaagacctttgatcccaagaaagaaaatcccattgtgttacttagtgacttttactatggacagcataaaggagaagggcagccggaacagaagactcacaccacctttaaatgcctcagctgcgtgaaagttctaaaaaatgttaagtttatgaatcacgtgaagcatcatttggaatttgagaagcagaggaacgacagctgggaaaaccacaccacctgccagcactgccaccggcagtttcccactcccttccagctacagtgtcacatcgaaaatgtccacactgcccaggagccctctactgtctgtaaaatctgtgaattgtcatttgaaacagatcaggtcctcttacaacacatgaaggaccatcataagcctggcgaaatgccctatgtgtgccaggtttgccattatagatcgtcggtctttgctgatgtagaaacacattttagaacgtgccatgaaaacacaaagaatttgctttgtcccttttgtctcaaaattttcaaaacagcaacaccatacatgtgtcattataggggccactggggaaagagtgcacaccagtgttccaagtgccggctacagtttttaactttcaaggagaaaatggagcacaagacccagtgtcatcaaatgtttaagaagcctaagcaactagaaggattacctcctgaaacaaaagttactattcaagtgtcactggaacctcttcagccaggatcagtggatgtagcatccataactgtgagcacatctgactctgaaccatcactccccaggtctaaaagcaaaatttcaaaaaagtcccattaattctagtttcagtaaatctaaagcaagtatttcaaaccaaattaaaaaacctcataaaacaaaaaatacaaaccatacattattcagtagcaccaaaaatagtgaaactagtggattatatatgactttttaaacaagattcaggatatatattatttgatctgaattttgaggtattattttaaaacatctggttttcatgttaactgtatctggcttaacacataaaaggtgtttgtgtgtgtgtgtgtgagagagaaaggtattaatttatttttttaattttaattttttttttttttactttagagacagggtctcactgttacccaggctggagtgcagtggcgtgatcctagctcactgcaaccttgaacttccaggctcaagcattcctccgcctcagcctttggagagtagctaggactacaggcgcagccaccacacccagctagttttttattttaattttttgtagcgatggaatcttgttatgtcgcccagggtggtctcgaactcctgaccttaggggagcctcctgcctcagcctccccaagtgctgggttgtgtgagtcactgcccctggcacctatttattgttttggtatttcatgttactcctaagcttgaaagctcttttttctatatacagaattcatagaatttttgaaatacttagttttctttacagctttttccatgcattcagcatttcatggttaactctagtcagactggaatggctttgttatgccctggcccacttgctgccgaattcccagaagtgcctctgctgtgctggcataaaataacctgaaaagattctgaaaagccaggatgtggaattgaaagagaagctgctgcgtgagcagagaccaagaaggcggaggttagttgagggagagcagtggttctttgttctagttgaaggataggcacacattcattctagtcttggggccaggtcaaaaggaacactgcttcagagtatctttacctacctgaaaacatccaaggaagccaaaccattcaaagtaaaatggttttgtttggtgaagggcccctgcagacatcaaacagccgtcatgtatcattggtttgaggtgaaatagcaataaaattaatagaatggtgcctggtactagctgacttcctgttctgtgatctaaaggtgaatttgattcattccctctcctctcccttctggctagccgttagtggagaatgaactggccatattctcagccacagctgtaaagcaagtttcccaaggggaagaagccctaatatctataatttgaactgtactggacccatagttttaactgaaaagggccaaacaagtggtgtctgtccagttcctggactgggctaaatttagttttcccactgttaagctggaatgaggactgtcccaacaacagtaggtacagtggacaaaaatagcccagggtgactgactgaatttaaacccataatggctttatatttttctgtgcatatatatcttaccctaattgaacatgtgaagcttgcaactttatgtcttgctttggacatgaatgtattacagcttgcagctattctgttaaatgtatagtttcccagttttttgacactaatgctgtttgggtcttacctgacacacaccagtgtgcaagaaatgtctctctaattcaataagttttaagacttagagttaatgtccttcatctgatctatcctatctaatctgtactatgggtgaatctttttcccttgctctccccaggggctgtttcacagtattctggagtaccttttgagtattggttcctgaacatcagcagtcttggctgcctctgtggactcccggagttgtctccctgcttgtgttctggtgccatcctttgttcctccacccctgaccaaggtgcccagcagcctgtcttcaccagtcaaggaatccgccatcttggctgtagacataggtctggagaaatctctccctttttccttgatttctttttaaaggtaccttatctctccccactcctttcttccctcctcaatctagttaaatttcctaagctttcacaaaaatccgggaagagataattaagagcttagcatccctcttagagtagaaggcagtacagataacaaagaagttgtgagtatattatctacattttagaaaattttctgactctagatccatagattctgttgtatttatttgccggacactcatttgattgatttgcaccttgaacactatactaggtcttttcagttacgttgcttgggttaagacactttgctaaaattacagcctgaatcctttctttagttgaagaaagggtatgtgtgtgcaagtgggtgtgtgtgtgccagtttttcttgtctcaggtagatactcccactgtgtataaatagatctacagacttttcatacttacctcccgtattctgtttctgtggtaaaaatatgaagtgttttagttgtatgttgagtgattggttggtattatcaacactgttgtttgcagtttcattaaagcatgctcttaaggagtacatatggtcattaattgccaactgtagattccagtgatctggcccctgcctacctccttcctctctttttcattctctgtcatgcttctccactgttttccccaatgacgcactattttgacacactggccttgctattccttaagcaaatcacattcttcccaatccaaagactttgcacatgctgttgtctttcttagaatgcccttcccctaggcctgcatggcttgctacctcacttaattgtttgacacttcctttggttcattgagcttcaaggctcttaaaatgccactgacaatgagatctccctttaaaaaaaaaaaaaaacttctacttttcctcttaaaggcactttactctctccccactcttttcttcctcttcaaagtatttaaatttcctaggttttcatgaaaaagctggaaagcgatcagcatcaagggctttgcttctgtcttagaattgagctagcttgagtcaatttctgtgcctgcaaccaaatgaaaattaatatagtgagttctttcaggagctttctctgtttttctattgatacctctatatatttttaaggcaatgtcactttgttttgtttacaaatatattgaatatgtcaagattactattttgttattgccctttgtgaatttccttgtctattttgctcgcttgttctttcaggtgaaatttattattttattaatgttgccaaaaattataagtaaaatatcaattatagtaataaaatgttttgtgaaaaaaa

SEQ ID NO: 4062 - DNA, 2005 bp, Homo sapiens
atgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacagttggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtggtcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgt

SEQ ID NO: 4063 - DNA, 2932 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacaggagcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcggggtacgtggtgcgaggggtggccgcggtggaaatgtaggaggaaagcgcaaagctgatgggtacaaccagccagattccaagcggcgccagaccaataatcagaactggggctcccaacccattgctcagcaaccgctccaaggtggtgatcattctggtaactatggttacaaatctgaaaaccaggagttttatcaggatacttttgggcaacagtggaagtagaaacagtagggcctctgtaaaattggagactgataggttgatcagaaactcaccctaaatctgaacgggtgccgctataatttgtgacatctggcaagatttccctttatgtatatattttaacaatccgcttggacacgaacaaagccacacttctaactgcttctggcgaactgattttatttttaatttttttcaataaagatattcttagatactgaaagaaatagttaatgagtttgcatttgtgcttgagaaaatttggctcaagtccatttggctgtagtgtcaacgatgtttccagtagtgtttagatttggtgtcttcaaaggtagttgattaaaaccaagtgtgtctttaatatcttgtatcagaataactttgtatgttaccaacttaaattgctagaataaggtaaattgatacacaactgctatttttaatttagaactttgacctaatttgggttttcaaaaccattttggctacttgtattctttatgctgttgtttatttcaataaaaaattcacacct

SEQ ID NO: 4064 - DNA, 6997 bp, Homo sapiens
gaggaggagccggaggaagagggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtaaacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggggctaggagtcctgcacccactagaaaggaatttggaggtattggagcccctcccagtcctggggtagctaggagagagatggaagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaagtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcattagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttac

SEQ ID NO: 4065 - DNA, 7039 bp, Homo sapiens
gggagctgctgcggccagacccacgggcagccgggcgggcggacgcctccaagaccagtctctgcctccgcagcgtcagcgggagcgggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtaaacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggggctaggagtcctgcacccactagaaaggaatttggagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaacaggagcaaccatcagggtaacaggtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcattagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttac

SEQ ID NO: 4066 - DNA, 5103 bp, Homo sapiens
agaaggcggagcctacctctcatcaggaccagtctgactgcacctgcatccttagctcagagcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttgatgtgtcaccggtggtggccggcctcatcggggcctctgtgctggtggtgtgtgtctcggtgaccgtctttgtctggtcatgctgccaccagcaggcagagaagaagcacaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccacgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatgtcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccagaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgcccttcaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaatctatatataacaatgtaaccatatacttgcatgtctaatacaaactgaagaaattagcctaactgccaatatcaagttgcagattttaatccatggaaattgtgttttgtgctgaattgtatttgctgattacctgaaattggcttctttttattgggcttctctggagaatttctcccactccccacctctgcagaagaaaattttgctcttataaaacctcatgttttcatcattcctatcttttctttttattgcctcttatatctctgctctttgacctcaaggtctagaggtctgcagtaagccaagaaacaaaggtggggtggatgaggcaaggtttgcaggagaaagaggaattgagaaatggggtatttttgctatcagctcttctgctatgaagtagtaaaaggcagtctataattaactgacagacctaactgaagcacagagaatacatcagacttatgcatccaagacatcagaacttggattttatcaaacttgatgacttctctaaaaggagctttggaaacttcaaattcagctataggatagtaccaatgaacacatccagctgatcccaaaagctgttttcaggtataaggacaaggagaggagacaagtgacgacagccattcccctttgcagctatctactgtagtgacagccatttcttggttgatgggttggaagtcatcagaggtttgaagaattacactggcctttgtttttctggaaatgccgaccatggagatgctttagagtcttctaaaatagcttagatgttgtaatgaggttagctttgcttcataaaacaggggccctcagaagttctccttaaatttttcaataaaaatttagctcttaaaaaaataacagtgtgactgagtgaatgaagataagttggattctttcagagcattcttttcctcaaaacgagctgcataattcttggaatttatgtcttaccacatggtggagggatgggggaactacaggatgcaattcttcttctaccaatgggcaatagaggttgagagagattcagcatctttctgggattagaattcaagtctctttactcctacagcagctgcgtctccaacgttgagactttgcagatggcacagactccatggataataggtaaacttggggccgggcgcagtggctcacgcctgtaatcccggtattttgggaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggatctcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctccccctaaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtcactttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaatttcgaaaaaaaaaaaaaaaa

SEQ ID NO: 4067 - DNA, 3837 bp, Homo sapiens
gttttcagcgctccgaaagccggcgcttgagatccaggcaagtgaatccagccaggcagttttcccttcagcacctcggacagaacacgcagtaaaaaatggctccgatcaccaccagccgggaagaatttgatgaaatccccacagtggtggggatcttcagtgcatttggcctggtcttcacagtctctctctttgcatggatctgctgtcagagaaaatcatccaagtctaacaagactcctccatacaagtttgtgcatgtgcttaagggagttgatatttaccctgaaaacctaaatagcaaaaagaagtttggagcagatgataaaaatgaagtaaagaataagccagctgtgccaaagaattcattgcatctggatcttgaaaagagagatctcaatggcaattttcccaaaaccaacctcaaacctggcagtccttctgatctggagaatgcaaccccgaagctctttttagaaggggaaaaagagtcagtttcccctgagagtttaaagtccagcacttcccttacttcagaagagaaacaagagaagctgggaactctcttcttctccttagaatacaacttcgagagaaaagcatttgtggtcaatatcaaggaagcccgtggcttgccagccatggatgagcagtcgatgacctctgacccatatatcaaaatgacgatcctcccagagaagaagcataaagtgaaaactagagtgctgagaaaaaccttggatccagcttttgatgagacctttacattctatgggataccctacacacaaatccaagaattggccttgcacttcacaattttgagttttgacaggttttcaagagatgatatcattggggaagttctaattcctctctcgggaattgaattatctgaaggaaaaatgttaatgaatagagagatcatcaagagaaatgttaggaagtcttcaggacggggtgagttactgatctctctctgctatcagtccaccacaaacactctaactgtggttgtcttaaaagctcgacatctgcctaaatctgatgtgtccggactttcagatccctatgtcaaagtgaacctgtaccatgccaaaaagagaatctccaagaagaagactcatgtgaagaaatgcacccccaatgcagtgttcaatgagctgtttgtctttgatattccttgtgagggccttgaagatataagtgttgaatttttggttttggattctgaaagggggtcccgaaatgaggtaatcgggcagttagtcttgggtgcagcagcagaaggaactggtggagagcactggaaagagatctgtgactaccccaggagacaaattgccaagtggcacgtgctctgtgatggttagcatcctagccgtgagttggaacttaaaggtttttactaggcaaggagaaattttctttctttctatattggattgcaagcttgggaaatcaagctacctttttgttgttgttgttgttgctagaaatggattgaattagtagaccagaaagtaacttcaaatgtgtattatgataatttccctatttattagaagagttggataaattttcataagatattcaatatctccttcagattaccagtgatataactaggaatagtcagacattttatgaatactgtgccagaatcccaaattataaatgtgacaatctcattggaacatgtcacaaaaagttaatgtgattaagatttaaaaacgaaaagtatgccttgccttgtgaaaatttatccatttatcttcaggttggggaaatcaatttttctttaaatccaaagatactaaaaaaatgtcctccagtttgtatttattaattctgtcatgtgcaaatggttgtcctgcatataaaagtatctggtcatttcagtttggtttgtaattatttgatgcaattttatcataagagtaactcagattcatttcaaaaggacagtgaacaagctgagaaattattttatcaaagggctgagttgagaacactgtggctgaaatataatttttctcccccctaaggttacatgtgagtcaaaattttgtaaaatataacctcacataagaaccatggccttggattattcactgcctgtcacaagcctcagtgtggcctgagaaatccctatgtacctttgtgaaattgttgaattagttagtgaataaagaaataaacttcaactagaaatccagttagaagtgcaattttcttataggaaataggtatagtgtgcaagtgtacttttaaggccatcgtttgtacccagagtcggcatggccacctaagtcttcatttaatttattgtcccccagaaaagattaagatgctacttgaaaagactgtgaagattttttacattgccagataaaaagtgttacttaaccaacaaacaaatgtaagactacaaaatcgttcaagagcaattctaatataatttacatatgttcacgcaaaatatgcttaggctgtcaaattagcacaacaaagaatgtgtttcactatcttttctaggctaatttgtcttgagctgttgtctatagagcagtttacagacttgtgtcttgtatcattttccagtgccagggttctgaaattcattcagaacctgttagattaaagctgcaccctgtgattatttgaaaagaattagcttgagagtaatgtcactatatttgagttcttagagaagtatgagtggaacttgagtacagttgaattattaaatatgcaagttagaaattaagtctactgaaaaatttacattttgagtcaggttttgtgtcagtactttagcagtttttgagaatgtgtttgatatcacagtgtttgtaaattctatgaaaaatgcattttccaaacaacttatacatgctttttatgactatgcctaatgtaaagaaaatgtattacattctgtatgtacaaagattaaaaatcaacctcttttttgtgctttaaaatgactttgggattaaaaaagcatatttcccaatcattgtcttcattccactacaaagtcacctcacagcatcttgctccactcggcatctctgtgaaagcaacatgaaatgaactgtagtaggtgtgtagtttggggaagtcaaatggccattttatgtatgtgcatttggtatcatgggccgtggaacagaatatatgttggacctctgaaaagttgtaaggggccaattctaagtattcttcacggcagccagaagttaatggtggtagcagctgaggtatggttgttggacgaggccgatttttttttttaacatggaacaatgaaaccaacaacaaacatttttaaaattaaaatggataatttgtaaatagtttttagcttttaaaatttaaagtgtttttgagtgtgaaaagttgagtaaaactatttgcaactggttttcagaaaagagaaaagaaacaacaaaggaattgaaacaggcagggagatcttaatacctaatttcatcatttctgaaaatgtactgttttagaatgtattacaatatcaatgtgaatatcttgaatcctgttacaaatcctgcactgtattaaacatgtaaattaattgtttgtctgattagccaatctcaccacccaaatggggaggtatacatgtttgaagaactgtgtaactcagtaattgatttgttctgatgttgtaactcaatagaagtgttttggaaggaagcatggtgtgtgagacagtgtctgttcttttgtgccagctctgtatgatgtttgtaagaccatgtttgtaagacatgaataaattgctgcttttgcccaaaaaaaaaaaaaaaa

SEQ ID NO: 4068 - DNA, 2193 bp, Homo sapiens
atgtctaagaactcagagttcatcaatctgtcatttttattagatcatgagaaggaaatgatcctgggcgtcctaaagagagatgaatatttgaaaaaagtggaggacaagagaataaggaagctgaaaaatgaactcttagaagcaaaacgtagaagtgggaaaactcaacaagaggccagcagagtttgtgttcactgtcacagaaacctgggcctaatctttgaccggggagacccttgtcaggcttgctcactgagggtatgcagggagtgtcgagttgcaggccccaatggcagctggaagtgcactgtctgtgacaaaatcgcgcagctaaggattataactggtgagtggttttttgaagaaaaggcaaaacgtttcaagcaagtcaatgttctcggcactgatgttgtccgacagtccattttaagaagaagtccaggagctgaagaagtacagagccaagagcaaacccgccaggatgcagaaaagtcagacacttcacctgttgctgggaagaaggccagccatgatgggcccaagagaaagggatttcttcttagcaagttcagatcggcaaccagaggagaaatcataactcccaaaactgacactgggcggagctatagcttggacttagacggtcaacattttcggagtttaaaatcacctcctggttcagacaggggaagcactggctcatcagatctcaatgaccaggaacctggtcctaggaccccgaagagcagtcggagcaatggtgtgaccccaggcactcagagttcaccagccccaagcacacgaactgtgacctcagtcatcagtagagagtatggttttgaaaattccatggatttggctgctattgaaggtacctctcaggagctcacaaagagtcaccgcagaaacacttctggcacaccttccatagcagtgtctggaacctctctctcctcagatcagagtcgatctgagttagatttgagtgagtcatttacagaagactcagaggatactgtaagcataagaagcaagtctgtccctggggctttagacaaggactccttggaagagactgaagaaagcattgatgccttagtgtcctcgcagttatctacaaacactcaccgtctggcaagtggcctatcaactaccagccttaacagcatgatgagcgtttacagtgaaacgggagactatggcaacgtgaaagtcagtggtgaaatccttctccatatcagctactgctacaaaactggtgggctgtacatttttgtcaagaattgcagaaatctggccataggagatgaaaagaaacagaggacagatgcttatgtcaagtcatatcttcttcctgacaagtcccggaacaacaagcgtaagaccaaaatcagaacaggcaccaatccagaattcaatgaaacactaaagtacactatcagccatacccagctggaaacaagaactctgcagctctcagtctggcactatgatcgatttggacgtaatagcttcctcggggaagtagagattccttttgactcatggaactttgaaaatccaactgatgagtggtttgtgcttcaacccaaggtggagtttgctcctgatattggccttcaatacaaaggagagctgacagttgttttacgttacattcccccagaagagaacctgatgcttccaccagaacaactccaaggaaataagacttttaaaaagggaaagaagaaggagtcacctgtaatctctggaggaatactagaagtgttcatcaaagaggcaaagaatttgacagcagtgaagtcaggaggcacttctgatagctttgtgaagggctacctgctccctgatgatagcaaagccaccaagcacaaaactctggtaataaaaaagagtgttaaccctcagtggaatcatacattcatgttcagtggcatccatccccaggatataaagaatgtttgcctagaacttactatctgggacaaggaggccttttccagcaacatctttctgggaggagttcgtttgaattctggaagtggtgtgagccatgggaagaacgtggattggatggactctcagggggaagagcagcgcctttggcagaagatggccaacaaccctggaactccctttgagggtgtactcatgcttcgttccagcatgggaaaatgtaggctctaa

SEQ ID NO: 4069 - DNA, 1329 bp, Homo sapiens
gtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcttaaaaaaaaaaaaaaa

SEQ ID NO: 4070 - DNA, 1214 bp, Homo sapiens
ggagggggattccagcccccctggaccggccggaggtttattctagagttactggcgggtagctgtgcttttctttcccgtttgtaggtgaaaccccattggcttcattggctccttgatttaaaccacgcccggctttctgccctctttgctgctgctgggccaggttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcttaaaaaaaaaaaaaaa

SEQ ID NO: 4071 - DNA, 1503 bp, Homo sapiens
gtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattgtgaaaccccattggcttcattggctccttgatttaaaccacgcccggctttctgccctctttgctgctgctgggccaggttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcttaaaaaaaaaaaaaaa

SEQ ID NO: 4072 - DNA, 640 bp, Homo sapiens
catttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacaggtacctctcatggacgttgccctcaagaatgtgttgtgtttgtgtggactctcgaatctcacccccttattttttccctggcatacatttggcagtcttctgtctcaggcttttgtaatgcagactgattcagccaaactaaacagtcaagcagttttcctctttcaatcctctttgcctgtggattctccatactctttgcaccagagtcttctttcaaacaaaactttttccctctcttgtttccaaatatttttaaaagactgaaagttaccttacaatgtgccaaaccagagcagaaaattattgtggcctgtctcctttttatgtgatccttgtagtagttaggaataaatatttctccca

SEQ ID NO: 4073 - DNA, 640 bp, Homo sapiens; identical to SEQ ID NO: 4072

SEQ ID NO: 4074 - DNA, 3028 bp, Homo sapiens
gaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaaggtcagaattcccagagtcctcaatgtttcaaaacatgctcagagcaaaatggttatgttctcacattgtcaaatgcacaaccagttctgcaatatggtaatccttatgcatctcaggaaacaagagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4075 - DNA, 1601 bp, Homo sapiens
cgggcggctgctgaggtgagggccgggccagaggagaggcatacccactggggcgtaggtctgggactccccctgtccgccctggcgcgacctcaggactctccgtgtcccctccgtgacccccgcggcccgggccgctctttgcatcttgtcttgcccacagctggcctcggccaggtccgagggcctggatgcgaccttggggcagcccctactcttccgggcagcccacttccgcggccaccggtgcagggcatgccccggggccgtggagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgaaaaaaaaaaaaaaaaaaaaaaaaaaaaaaaaaaaaaaaaaaaaaa

SEQ ID NO: 4076 - DNA, 1936 bp, Homo sapiens
cctcgctagtggcgggcatgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataacgtttatgtagctgaaagattccaagaagctaagggtgattcaccgcaggaaaagctgaagactgtaaaggaaaactggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaactactgaggatcagagtaatccaagcaaatgtgaatcattttacctttgacaaaggtaaatcagactatgaagttttttttatacaggatgatgactatggaaagagtactcttgtttccttatattatggaggcaggagtttcgttttcaaaattgttacaaattgtagaagccacggtgttctgtgatataagtgtgtgtttttcataaagcaggcagaactcatctaggtaaattacagttcctaggtataattcacattgtattcagagttgatggttgtacatataagtgattgctggttttagttgcaactttgtataaaagggactgagaaatttataaacttttttcttactgtcttttttctaaagtaaaaacaaagaaattatgtgccagatttatgcatattattttatgttgcatagaataaaatttttaatctttaattttacatttcctaaatatattttaagacgaaacatttgttctatagcttttccctttttttaagtaaggaattttatttttttctgaattattttctctcgtgagtatattgatccagaaagaaaacttgtattatgtgtgttttaaaatgagaaatctaaaaaacgaaaagtctccaaagtctctggaatttgaaacactttgcataacgtataaaagcctgtttaagagacagccaactatggcctgtggatcaaatccagcctgctgcctgctttttatggcctgtgagctaggaattgtgtttataattttaaatgtttttttttaaagacttttatgatacttgaaaattaacatgaatatttagtgttcataaataaagtttgttgaaacaca

SEQ ID NO: 4077 - DNA, 3176 bp, Homo sapiens
gggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaaaaaaaaaaaaaaaaaaaaaaaaaaaaaaa

SEQ ID NO: 4078 - DNA, 2095 bp, Homo sapiens
acgtttaaagctgagcgacccagtgccactggagacggtcagcttctccactcaggctcctccagcccgagccagaagaccccctcccccataattctgggggccgatggaagggagccgagtcagatcgcgaggtacccatagccgacagaccggagcgacagggagttgccataagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaatcctgagagcaaggaagaacatgcgatatacacagcagacctagccatgggcacaagagcaccctccaatgggaagtataagggtccataccagaccctggggggaagggctctgaaggagaacccagttgacttgcctgccacagagcaaaaggagtgagtggaacagagttgcttcttaataggagcacattctttgcctgccttcccttcatcctatcctctttgcttgctctcacctcaggaattgcttggattgatacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcatacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctatacaggaatctctggaaaactatcagaagacaaagtttgacaccttgatacccactttttgtgaatacctacccccttctggccacggtgccatacctgtttcttcctgtgactgtagaaacagttctagacctttgtgatagaactaaaatgctctctgtactctagtctcctgcctcctcagttctgcaagtagtttagtaggaatgaagtggaagtccaggcttggattgcctaactacactgctaaaaatatttgtaatccttaataattaaactttggatttgtt

SEQ ID NO: 4079 - DNA, 3752 bp, Homo sapiens
cggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccaggagcacacgtaccgtgtcgtccgcttcgaggtgattccccagagcatcaggctggaggacctcaaagcagatgagaagagttcgtgcactctgcctgagggtaccaactcctcgccccaagaaattgaccccaccaaggagaatcagctgtacttcacctactctgtccactgggaggaaagtgatatcaaatgggcctctcgctgggacacttacctgaccatgagtgacgtccagatccactggttttctatcattaactccgttgttgtggtcttcttcctgtcaggtatcctgagcatgattatcattcggaccctccggaaggacattgccaactacaacaaggaggatgacattgaagacaccatggaggagtctgggtggaagttggtgcacggcgacgtcttcaggcccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcttgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtggccaggcattctctccctgccctctctggcctctggggtcatactcacttctttagccagccccatcccctccaccccacacctgagttcttgcctcctccttttggggacacccaaaacactgcttgtgagaaggaagatggaaggtaagttctgtcgttctttccccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggattttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtcctacaaaaaaaaaaaaaaaaaaa

SEQ ID NO: 4080 - DNA, 1764 bp, Homo sapiens
gtggctgaggccggcagcagcgggcggcagctgcggcgcaaccggctccggagctgcctggcgcggccgggcgggcggcgccgctcaggctcgggctccggctgggcccggcgcggcctcggggctgcccatggggcgcggggggccgggccggtgacgccggacgcccatggacgcctctgaggagccgctgccgccggtgatctacaccatggagaacaagcccatcgtcacctgtgctggagatcagaatttatttacctctgtttatccaacgctctctcagcagcttccaagagaaccaatggaatggagaaggtcctatggccgggctccgaagatgattcacctagagtctaactttgttcaattcaaagaggagctgctgcccaaagaaggaaacaaagctctgctcacgtttcccttcctccatatttactggacagagtgctgtgataccgaagtgtataaagctacagtaaaagatgacctcaccaagtggcagaatgttctgaaggctcatagctctgtggactggttaatagtgatagttgaaaatgatgccaagaaaaaaaacaaaaccaacatccttccccgaacctctattgtggacaaaataagaaatgatttttgtaataaacagagtgacaggtgtgttgtgctctccgaccccttgaaggactcttctcgaactcaggaatcctggaatgccttcctgaccaaactcaggacattgcttcttatgtcttttaccaaaaacctaggcaagtttgaggatgacatgagaaccttgagggagaagaggactgagccaggctggagcttttgtgaatatttcatggttcaggaggagcttgcctttgttttcgagatgctgcagcagttcgaggacgccctggtgcagtacgacgaactggacgccctcttctctcagtatgtggtcaacttcggggccgggggtataaaatgtcctttccacaactcagtggcctgctggtgatgcttcgattctgtccctcgttagaatcagagtggacgtccctttgccttccatccaggggttatctttggaatgctcgagtgctcattgctgtgaacttataaaatgcccttgggtgttcatctttcttttgcacttttaaataatatcttaagctcctttacaattaaagaattagcacagtgaaaccatacacagagagaaacattggttattgtcctcagtgtttttcgctgatacttattttgatgaaagtgataccacgttatatagctgtttctctgtcgctcctttttgttactcacagcccatcctgggcatctctccaggttagcaggtggggtttggagttgtttttgttacaattggtattcctggcttgattccattacctggtgttggacattgggttcttttatgcttcttgccaccacaagcagtgctgtagtgggcatctctgccaggtgttctttttgagaacccttgtcaccatgtgtgaaggaaggagtaattttgaggagccctggtgtcagcaggagaacctggagggagatgaagtgtggggacggtcagttctagctgtgagcactgtcctcactctggaactcatcagtggcgccgatggatactggctcatagtgcttctgaagatcaggtctggatatctcactctcctgagatgccagtatagacacagaaccaaagcaaagtgtttactaagtaaaaaaataaaataaaaaaacacttctatttcttataaaaaa

SEQ ID NO: 4081 - DNA, 6641 bp, Homo sapiens
ctttcaaataaggtgttgatttatgtggtcttgagaaatctttgttgctctgatcttaagtttctttttataatattagaatcatagtttacctacattacagggcttttatgaagattaaatcgagcatcgtgggtagtgttttttcagcccctgtgactaagtaggttataaatggtcctcagtcatcatcatcataaatgattcaaggcctgaatggcagaagaagaagaggaaaactcaagtgaaaagtgctagacatagaacacagcttacctaataaaacatgctactggctaactaagctggggtggctttctgccccctctacttaaatttaagaaagaaaaacagaaacgtctctgcatctgccactgcataccctctcagagcacagaccaactttgcccttccttaaaagtcccagggtttacctaccaacttttaggaaataaataaccagcctcaaagcttggcaaagagggcatcagtatcagctctagaggtttgctccgatttatatctcctcctccagtaaagtcttctgctcccactcccagccaaccccgctcaacgcccacccctcactgcggcactggacgcgcgggggatgcggggttgttcccagagtagccgctaaggggagccggacgctagaccgccctcccgcgttcccatgacaacgacaccggcgggcgcgtagcctggagagcgaagtgccggctacagcaggtgtcggattgcagtgcgctcgctgaggctccggaccttggagcgtctagagtctggctactgttcctccgcctccctctcgggcagctccctaagccggctgggacgcgcagagtgaaaatggtccaccattcaggctccattcagtcctttaaacagcaaaaaggtatgaatataagcaagagtgagataacaaaagaaacttcgttaaaaccgtctcggagatccctgccttgcctcgcccagagctacgcttactcaaagagcttgagccagtctacttccctcttccagtcaaccgagagtgaatctcaggctcccacatctataaccttaatctccactgacaaagcagagcaagttaatactgaggagaataaaaacgactctgtgctgagatgttcatttgctgacctcagcgatttttgtttggccctaggaaaagataaggattacacggatgaatcagaacacgctacttatgaccgatctcgtctcattaatgactttgttatcaaagataaatctgaattcaagacaaaattatctaagaatgacatgaattacatagcatccagtggacctctgttcaaagatggcaaaaggagaattgattacatcttggtttatagaaagacaaatataccatatgataaaagaaacacatttgaaaagaacctcagagcagaaggcttgatgttggagaaggagccagctattgcaagccccgatatcatgtttattaaaattcacattccatgggacacgctgtgcaagtatgcagagaggctgaatatcaggatgcccttcaggaaaaaatgctattacactgacgggaggagcaaatcaatgggcaggatgcaaacttattttagaagaatcaaagactggatggcccaaaacccaatggttcttgacaagtcagcttttccagacctagaggagtcagactgctatactggccccttcagccgtgcacggattcaccacttcataataaataataaagacaccttcttcagcaatgctactcgaagcagaatagtctatcacatgctggaacgcaccaaatatgaaaatggaatatcaaaagtgggtatccgtaaacttataaacaatggctcatacatagcagcgtttccaccacatgagggagcctacaaaagtagccagcccattaaaacccatggacctcagaataacagacatctattatatgagcgctgggcacgctggggaatgtggtataagcatcagcctctggatttaatcaggctgtactttggtgagaagattggactatactttgcttggctgggatggtatactggaatgttgattcctgcagcaattgttggtttgtgcgttttcttctatggattatttacaatgaataatagtcaagtaagccaagaaatttgtaaagccactgaagtctttatgtgccctctctgtgacaagaactgctccctgcagagactcaacgacagctgtatctatgccaaggtgacatatttgttcgataatggagggacagtcttctttgctatttttatggcaatatgggccacagtcttcctggagttttggaaaaggagaaggagtatactgacctatacttgggaccttatcgaatgggaagaagaggaggaaacacttcgtccccagtttgaagccaagtattacaagatggagattgtaaatcccatcacgggaaaacctgaaccacatcagccttcctcagacaaagtcactcgtcttcttgtttctgtctcaggaatattcttcatgatatccttggtgatcactgcagtgtttggagttgtggtgtaccgcctggttgtcatggaacagtttgcatcattcaagtggaatttcatcaaacaatactggcagtttgcaacatctgctgctgctgtctgtatcaatttcataatcattatgttgctgaatcttgcttatgaaaaaattgcttacctcctcaccaatttagaatatcctcgaacagaatcagagtgggaaaacagcttcgccctgaagatgttcctcttccagtttgtcaatttaaacagttccatcttctatatcgctttctttttgggaagatttgtaggccacccaggaaaatacaataaactttttgaccggtggagactggaggaatgtcatcctagtggctgtttgatagacctctgcctccagatgggtgtcatcatgtttttgaagcaaatatggaacaacttcatggaactaggatacccgttgatccagaactggtggtcacgacataaaatcaagcggggaatacatgatgcttccatacctcagtgggaaaatgattggaatctgcagcccatgaaccttcatggactgatggatgagtacttagaaatggttttgcaatttggttttaccaccatctttgttgcggcttttcctctagcccctcttttggctttgttaaacaatatcattgaaatcaggctggatgcatacaaatttgtcactcaatggcggaggcctttgccagcccgagcaactgacataggtatctggcttggaattctcgaaggaatcggtatattggctgtgatcaccaatgcatttgtaattgctattacttctgattacatcccacgttttgtttatgaatacaaatatggcccctgtgcaaatcatgtagaaccaagtgaaaattgcttgaagggatatgtcaacaatagcctatccttctttgacctgagtgagcttggtatgggaaaatctggttattgcaggtacagagactacagaggcccgccttggagttccaaaccctatgagtttactttacaatactggcatatccttgctgctagattggccttcattattgtgtttgagcaccttgtttttgggattaagtcattcatcgcatacctgattccagacgtaccaaagggtctacatgaccgaatacgacgagagaagtacttagttcaagaaatgatgtatgaggctgaactggaacatttgcaacaacaacggagaaaaagtggtcagcctgttcaccatgaatggccttagttgacacctgttacccattaggggtgataacattaatgggaagaaatgatggcaactttgaatgctaggtgaaatctaggaggaaggcatacttggcaaaccacatgtataatatgctacttggaaatgtatcacagccatctctgggatttgaaatatccagacttgtagggaagaaaacaatgacttgacgaccttaaaaagggttagattgacattgcaggaagccaggatgtaattctcagaaccagtctcagggagatatatgcttggagaactctgccttccatcaactgcagtgtaatgggaaagagggtggtgaggttttgaaagacagatttccatgtaaatgtgcacaagccaggcatggcttaaaatatcatgcagtcttcactcacatactaatttgactttggaaagtatggttgagttcagatacttataagaaatgacttaaacaaatccttgccttggctgccagaactctacatcccttcagtttacaggttggtaggaattgcccatgtctcttgctgagattatggatctgtgccacaggggatttatgctgctttacattgactatgcagttgaagagttgcacatcacctttagtggtcaaaccaaaaatctaagattccaaaaagaacagcattcattgaaataatattccattgcattggctacttcaagtctcttttacccctggcagagccagttgcagtgcaattttttgtactaaatgccaataaagccacatacttataaactatgaatggctattcttatatagtttagaacacaactaatccatactttattgtggaaggctgttttatagtatatttaattttttctctatgatttattacaactctcacggaatattaacttgaaatgctgtaaatacgttggttttccttgtccctttgcaccttgacagtacgtagtatacattgtggtttatgcagctctgacaccagtttttgctattgtaatatgtttattcgggaaaactgaggccagatgctctgcaacacttacgctttttcaacaatgtgcactcttactcatgaactaatgaaaataatgcatgaatataaatctatattatttgctaaaaaaagaaaaaacatttgtgttttagtttcttttttcatgactgaagggagttttatgttattatttcttccatagttttgttttggtttatttttaacaacgctctagaaacaaagtcaaattaatcacaaaagacataattttgctttgttgtggaatttctatttcaacgtcaactctgtatctatgagtatgtctgttccacagacagatgaggcaggagtgatggggcactcaagaaagttcagaggaggcataagctatggaggttggaaaggaagaaagagaagagctgaagtaaatgtatggtagaaattaagacgtttctttgcaaaacaaggaaatcacacatatgcacacatacatatttatggttactatgattgttattatttgtccaatcaagcaaagcaccattatttctaacatataaaagaccagatcaaacacaatggaaataaagctactacatatatatgccagtatttctctagtaagattatgtttctcttactagaaaactattttctaaatattaacactgaaaatgttttgttagcttttccttctttctctccagaagaaacatggatagatgatagctgtttcattgtttgtttttgtcaagcatattcactttcctccttgtcctctgattctgagcaaagggcctcagactctgaacttccctcaagtgccgttgttatgtgaactcttccattcagattccagagaggttctcatgctccccccccctccttatttgtagcaatcgtagcaactaattccactaagtacaagggagttttttacactcctccatttttatagcatctgcattttttttttttgttaggtacatgtatacacctgcctgagtataaatactctctctacctaataataacatcaaccaacatcttttccaaattagggccacagaacagcaacatttgtctgacagtagtataaagaataatgatagctctatccttaagaagtatttcctttcctttttatatagtcccgttagggtttaaaaccatattgatcaactagaaagaaaaatatgaaaagagaaaaatattttaatttaaaaattgtaatacattgatttataaaatgccttctctgatacttttgaaacagatgtgaaaaacagaaaaagaaaaaattgtctgaaatgtttattttgcaaaacagtgcaatagaatctagttatgccttcatcactgttgacagtaaatactgacagccccttgcagtgtgttagttttagatcactctgttttagttgagagaaatgttttatatcatggtttttatatgaatacaaattatttctcaaagatttatagcacacactattctcaggaattctgtattacatgaatgctgcttatatattttcatattctaacttgtcttttcaagcaaataactaatatatatgtgcatgcagtctgccttgacaagttgttccaagctgaagagctttcactgtacaatgtgtggaaaatcaccatagatcatggctgaaatagtttgtaattgtctgagtctgtgcacgtacttttagataaaatgctgctgagtgactgcatgatgagatacaacttctgaatgctgcacattcttccaaaatgatccttagcacaatctattgtatgatggaatgaatagaaaactttttcactcaataaattattatttgatatggt

SEQ ID NO: 4082 - DNA, 1614 bp, Homo sapiens
ggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctgaggccattgctccatctcacctctgctccagaaataaatgcctgacacctccccacaacctgcaatctgtcgggcactcttctcgttcaactccctgtagccctttgggactttgcggtcccctaagtagaaaattcctatgggcctgtctcctgggggcctctgtctgctggtggtctgcttaccacagaatcctaaggggcaggagtgcctgggcatgtgtctgtgggagccttgcagtcagttgtgtttggacaagtgcaacagtcaggctgctgattcctgtggcatgcaggctgtagaggttgacaaatggaggggggtgttgagggtgagccctagttgattttttaaaatttaaactctggtaagaacatttaatatgagacctactctctttttttctttacttatttatttatctatttatttcaagacagggtctcactctgtcacctaggctggggtgcaatggtgcaatcatggctcactgcagcctcaacctcccaggctcaagtgatcctcccacctcagcctcccaaagtgctaggattacaggcatgagtcaccgcgcctggccaagatcacctaacaaaattgtaagtgtgtacgatacttaaaatttaagagattatgtgcacggcagacctctagaactgaatagtcttgcatcttgcataattcagaacttcatcatcttgcataactgaaactttgtgcctgttaccagaaaaaaaaaaaaaaa

SEQ ID NO: 4083 - DNA, 2814 bp, Homo sapiens
ggtgttcagagtttcggttctcttttctgtgatcgtattacttatgcaaaacgagcccagtcacttgcgcggccagagaggggcaggtgctgggcggcggctgacgggcgcagcaccctaggcccagtgtctggctccagccccgcatccggcgccggccccgcatccagctctggccctgcgacaatagagtccggaagtgcaggcaaagcggctcccgggagcgccgcgcggtcctgcgcgggatcagcgagggccgcgccccggcgggcgggcggcatggctgcagtgctggctctcagggtggtcgcggggttggcggccgcagcgctggtggccatgctcttggagcactacggcctggcgggccagccctcgccgctgccgcgccccgcgccccccaggaggccgcaccctgcgccagggcccggagacagcaacatcttctggggcctgcagatatccgacattcacctgagcaggtttcgagatccaggcagagcggtagacttagagaaattctgttctgaaactattgacatcattcaaccagctctcgtcctagcaacaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgatgcattcaatattccaagtctggacagcatcaagaattattacaggaaatattctgctgtacgtagagatggctctttccattatgtccacagtactccctttggcaactattcgttcatctgtgtagatgccactgtaaatccagggcctaagagaccctataatttctttggaattttagataagaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaaaaaaaaaaaaaaaaaaaaaaaaaaaaaaaaaaaaaaaaaaaaaaa

SEQ ID NO: 4084 - DNA, 5198 bp, Homo sapiens
gcagcgggcaggcaagggcggccgagcgggcggcgggcatgagcggggcgggcagggcgctggccgcgctgctgctggccgcgtccgtgctgagcgccgcgctgctggcccccggcggctcttcggggcgcgatgcccaggccgcgccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatatgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctctctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagaca

SEQ ID NO: 4085 - DNA, 5691 bp, Homo sapiens
atgggtgtgcacactcctcgacctgctcccttccacttcgtcagcctggccgggggctctttcaagaggtggggccgcttggtggcttctaagtcgtgcctctccctctgggtaataaacgccttgggggcagggactttgcagtcttgcttattgaggcgttttccaaaacagggaccgagggctctaacacccgtgcggagggtggccggcgggggcgggagtttggcagaatgcggctggagaagaggccgcggatcgggacgccgggaccccacaaactggcagccaggaggcgggccagccgaggatcgggggggctcggactccccctgcacccagtccactgttcggagggacttagagcagggtcccttccctgagggcctcgcccccgaggacgtggcgccggagccgtgcgacccattggcttcagcgggtgggaagcctggggccgggacgcgcgttcgccccgcgctggggttgaacctgcgtggatgtgcggcgggtgaggaaccgcggagaaggcggtcagctgctgtgtgggaaggtgacagctttttcttgaagctgaacatcaagctcagtttcgaggtcatatttgatgacttatttgatggcttagtaattgggtcctttggtcgtgtctacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctctctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagaca

SEQ ID NO: 4086 - DNA, 3734 bp, Homo sapiens
caaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaatggaaa

SEQ ID NO: 4087 - DNA, 2255 bp, Homo sapiens
gatgtgggcacgcctcagagccagaagtttatggctcccacctgctcaatctgacaggaagcttctgctccccagttctccccagccactgtggtctacagattccaggaaacccatccccctgtgacctcagggtgtgctctgttctccaccctagggaccagaaggagccaggagtaaagaactggcttacttggccgccactgggaaattctgggtaattcgagacgccctggaatttggacccactccgctgataggtggtgggcagggttctagggaacacaagaggcggagccaggtggcttccctgtgctggcattcttggctctctctctctctctttctctctctctgtctctctctctctctctgtctctcagccttgaagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccgttccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttcaaaataaaaaaaaaaaaaaaaaaa

SEQ ID NO: 4088 - DNA, 454 bp, Homo sapiens
atgcccgcaaccccgtccctgaaggtggtccatgagctgcctgcctgtaccctctgtgcggggccgctggaggatgcggtgaccgttccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtacctcagagtgcagaaccacagacggcttcggctgtgcctagggcaacagccaacctaggagccagcgggctttcggggaaaaaaaagaaaaagacatctaaaataaaatgtttaaactgtttcaaaataaaaaaaaaaaaaaaaaaa

SEQ ID NO: 4089 - DNA, 5744 bp, Homo sapiens
gtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagcccacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattccccaagaggtcccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcctgtcaggcttcctataatatgaaaagaagtcaccattggggaactagagaccccagaccttttcatatggatatttgagaatgtaatgcatctcaggcctcgtgctggaactctagggcactctaggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtata

SEQ ID NO: 4090 - DNA, 3436 bp, Homo sapiens
ccactacctctagactgccctcccgggctggcgtcccacggagtctcagccgcgcaccccttcctcgcgttaccctccttccggacagcaccccctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgccatggcgtgcagcctcaaggacgagctgctgtgctccatctgcctgagcatctaccaggacccggtgagcctgggctgcgagcactacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctccttcccgctggacgccatcctcaacgcgcgccgcgccgcgcgaccctgccaggcgcacgacaaggtcaagctcctctgcctcacggaccgcgcgcttctctgcttcttctgcgacgagcctgcactgcacgagcagcatcaggtcaccggcatcgacgacgccttcgacgagctgcagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcctgtcggacgactgcaccattgtggcttacggcaacttgcacccacagccactgcaggactcgccaaagcgcttcgatgtggaggtgtcggtgctgggttctgaagccttcagtagtggcgtccactactgggaggtggtggtggcggagaagacccagtgggtgatcgggctggcacacgaagccgcaagccgcaagggcagcatccagatccagcccagccgcggcttctactgcatcgtgatgcacgatggcaaccagtacagcgcctgcacggagccctggacgcggcttaacgtccgggacaagcttgacaaggtgggtgtcttcctggactatgaccaaggcttgctcatcttctacaatgctgatgacatgtcctggctctacaccttccgcgagaagttccctggcaagctctgctcttacttcagccctggccagagccacgccaatggcaagaacgttcagccgctgcggatcaacaccgtcctcatctagtccaggcagaaggagaccacaacctcctgggaccactgccacctgcaagagccctgcccaggagatagaagacctggactccagcccaccgtggccactggagacctcaggccagttgtttaccctccagcctccagtctgtaaaatggaggttgcattccctacttcctaaactctcttccagcatcgatgttctgtagctctgaccttgatagggatacagctttgatccaaggatgtgacatggcttctcctcagggcaacccctgcccaaccctcatccccatcttctcaggggcaggggactaccttccagtgtctccctccagcccagccctgacctcaggaagtgtcagagcatggccagtagttggcagcccgaaagacacacagcaccctcttatgtcccatggcctaagacttacccctgaccaagctagtgatgggccatttacccttgaccccagtccacagtggtcacaggtagtacctggtcctagggttgcctgagagccaacctctcctgccacccccacaccaagaactatatggttcctacttctcccactgatctgctggtcagtgatgatgctgtggcctgtggaaggcacctggtagttgagtccacacattatagtcatgtgccaccaccttcctgcccacaggccgagggacagggtgagggtatacccaaagctgatgcagagcccattagcctaaaagcaactgcaggacaagcctccctggatgatcgaggtccccagtagctctgaacaagagtccagccaaccctcttcagccaggcctctgtgacctgctagggtgcaggaggcttccagaagcagttgttgtaattaggacccaagcactgggaggggctgttggctagaccccttgtcagacttggcatctatctcagttaggatcctgctgcagaaaacaagagccacttgtagctggtttaattagacaaggatttactacctggcccctggtggcttgcaaaattgttggaagagctggagaagcagactctgctgaatttccaggaactcccagcgccagattcatcatgtctgttgtgaccaggaaagctgcccccatctgcaggaagccactatgccagaaagctgctgactgcagaactaggctccctctgccacggtccgtgccagccaatagatgtcctgaggcctgcccctctcccacttcactcagttcccaaatctaaatttttacaagagattctgtttgggggaacttaagtcagatccagaaccttggctgcaagggagtctgggaaatgtcatctccctagaaggaagttagggtgggtggagcaagccccacctgcgtttttctgccacagcatccaatcgtgaagaactcgggagagggtggagtccacatctagggttgtcctgccccttggctctatccctgcccagaggtgggaactggaggagtgggctgcaagactgagcctaaatgtctccccggccttgacttttctttctagtcctggggcctagattctgcacttggggtctctgacacaacacaccatcccaaagtagccggaagagctaaacacagggggttcttaaaatggctgcccccgccacccgggcctcccttgggcaaaaggaattgtcagccctaccccaacccttcaactaccagaatctgggccaccccagcagtatttttatttaaaatgttgcccattttatgagttatgatcaatttgtattaaattaaagttacagatgtc

SEQ ID NO: 4091 - DNA, 2217 bp, Homo sapiens
ccctacctcatagatatgtaggacatccccgggcccggaatgcggctctctgaccctctctgtgccctcccccgccccccgaaccaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttctcccgaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4092 - DNA, 1914 bp, Homo sapiens
ccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcacttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttgaaaaaaaaaaaaaaa

SEQ ID NO: 4093 - DNA, 3047 bp, Homo sapiens
gggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaaggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaaaaaaaaaaaaaa

SEQ ID NO: 4094 - DNA, 2970 bp, Homo sapiens
gccgcggcgagagcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaaaaaaaaaaaaaa

SEQ ID NO: 4095 - DNA, 3136 bp, Homo sapiens
ggagagcgcgccacagaacgacttttacgcaggcgcagaagcctgtttcccctcacccgcggcttccaccctgcgcaggcgcaaaaagccgcgctggcaacctccgcagcggtcgcgcgcacccttcacccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgcctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgctgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctccttctcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttactttaaaaaaaaaaaaaaaaaa

SEQ ID NO: 4096 - DNA, 3148 bp, Homo sapiens
ggagagcgcgccacagaacgacttttacgcaggcgcagaagcctgtttcccctcacccgcggcttccaccctgcgcaggcgcaaaaagccgcgctggcaacctccgcagcggtcgcgcgcacccttcacccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgcctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgctggtgagccccccgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctccttctcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttactttaaaaaaaaaaaaaaaaaa

SEQ ID NO: 4097 - DNA, 2594 bp, Homo sapiens
accaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcctgtgctcgggacggcggcgttggcggactgatccgcggcggtgaagagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggaaaaaaaaaaaaaaaa

SEQ ID NO: 4098 - DNA, 2359 bp, Homo sapiens
agttccgtcagagcggacatcttgtggctgtgtcgtgcgcgtgagccccgtagggccggggaggcaccagctgccgcgcggggaggaggccgaggccgcagcttgagggaggccccggcccctctaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggaaaaaaaaaaaaaaaa

SEQ ID NO: 4099 - DNA, 2576 bp, Homo sapiens
gtcaggggtgacacagaatagctcgctgcgaggatagcaatacacatcaagtctcccttcctttatttctttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaataggttagcaagagagtggacagagaaatacgctatgttgtagggtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggaaaaaaaaaaaaaaaa

SEQ ID NO: 4100 - DNA, 2568 bp, Homo sapiens
cgcgcgcgcagtcgcgcgcgggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacatacaaaagcttttgatgactggtaactggtatccttccaaataaatgcattgcttggtaaaaaaaaaaaaaaaaaa

SEQ ID NO: 4101 - DNA, 2901 bp, Homo sapiens
gccgggagtcggtgaggcggctgcaggtccctccctgcggagccgctggtccggctggcggagatgtgaccgcgggcccggccggcctgcctcaggcgtcgcgtcagctcccgtgtccgtgcccttaacccacaccgatggcgggatccggctgcgcctggggcgcggagccgccgcgttttctggaggccttcgggcggctgtggcaggtacagagccgtctgggtagcggctcctccgcctcggtgtatcgggttcgctgctgcggcaaccctggctcgccccccggcgccctcaagcagttcttgccgccaggaaccaccggggctgcggcctctgccgccgagtatggtttccgcaaagagagggcggcgctggaacagttgcagggtcacagaaacatcgtgactttgtatggagtgtttacaatccacttttctccaaatgtgccatcacgctgtctgttgcttgaactcctggatgtcagtgtttcggaattgctcttatattccagtcaccagggttgttccatgtggatgatacagcattgtgcccgagatgttttggaggcccttgcttttcttcatcatgagggctatgtccatgcggacctcaaaccacgtaacatattgtggagtgcagagaatgaatgttttaaactcattgactttggacttagcttcaaagaaggcaatcaggatgtaaagtatattcagacagacgggtatcgggctccagaagcagaattgcaaaattgcttggcccaggctggcctgcagagtgatacagaatgtacctcagctgttgatctgtggagcctaggaatcattttactggaaatgttctcaggaatgaaactgaaacatacagtcagatctcaggaatggaaggcaaacagttctgctattattgatcacatatttgccagtaaagcagtggtgaatgccgcaattccagcctatcacctaagagaccttatcaaaagcatgcttcatgatgatccaagcagaagaattcctgctgaaatggcattgtgcagcccattctttagcattccttttgcccctcatattgaagatctggtcatgcttcccactccagtgctaagactgctgaatgtgctggatgatgattatcttgagaatgaagaggaatatgaagatgttgtagaagatgtaaaagaggagtgtcaaaaatatggaccagtggtatctctacttgttccaaaggaaaatcctggcagaggacaagtctttgttgagtatgcaaatgctggtgattccaaagctgcgcagaaattactgactggaaggatgtttgatgggaagtttgttgtggctacattctacccgctgagtgcctacaagaggggatatctgtatcaaaccttgctttaatcagtaacctaaggactgtttcctttttctcctcttccatttcttgggttattccacatatgaatgcaggactacccccttaccattttaagaaggtactttatacatttatttaatcctactaatgtgcagccattgcccaagcagtgactgcgttgcatacatttggcactgagtaggacaagacctctcagctatacattgaggggttttagagcatccatgtgggcaacccttttttgtgcgggagagcaggtgttgctcttcagtatgtagcctaaaaaaatcttaattatttcatggatcatgaagcaaggatgaataatatcatgtcttggtaaatactaacaaatttgttaggtttggtgacatcatttacagattatttctttatgttgtccagtggttcttccttattgttgatatccataagctggcactggatgctctcagtaatgttaagtaattgtcaagcagcagttacctactgtgttcttaacactgagttgtgaattttttcttaaagcagtactgtagtactgaatattcctttaaaggaactgcagtgagcctatctaagtttttttaaattaaggcttttaaaatagaaagctgatgcttgatcttgcacaatttttatgtctagtatgtatgcttgagtgaatgtgtgagtatgaatgattagagaaaatttgagtcagtgtactttatagtgtgaatcctgtgagctaatacagtctatacttatttcttccctacctgtttcacatccgtaagatttaggatatacattttttgagaggtagtctgtctgatacaatgtaaatgacaaaacataattcctgagaggcccagaacaaactggagtctagcctggagttaaattgagacttctaaaatgattggaacaaagactaagttgtgccagatgtaaatcaacccctcttttagtttactttagactttgtattagctcatcttttttgtagtaaatctatagttttaaggtttctcaagatgtggctctacctactatgatgaaaattgaagtgggtcaaaagaattagatgtacagtgaagggaaaagaaaaaaaatgggcgaagagagggtggaaaataaaaggattcttttttcttcctttctgtttctcgtatccctgctccctttttcctccccttccctcattctttgcctctatccttagctgaagacaaactagaggagcagcatcccaggtagtttggcttttgactgcaaggtagttaagaaaggtgtagatataatgaggtagaagtagaaaggaagaaaaactcaaagaattctgaaaaggattcatagcaacataatgtgtccctgagtagaggatgctgctatgcgtgagttcatggacacaagttgattacatggtttttagaattataattatggattcttcttatttcatggtaggttgtctttaaagatataaaaattaggatgcctttatgaagcactgattatacc

SEQ ID NO: 4102 - DNA, 5228 bp, Homo sapiens
ggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgagaagcacgatttggaggtcgccgtcaagtgcattaacaagaagaacctcgccaagtctcagacgctgctggggaaggaaatcaaaatcctgaaggaactgaaacatgaaaacatcgtggccctgtacgacttccaggaaatggctaattctgtctacctggttatggagtactgcaacggtggggacctggccgactacctgcacgccatgcgcacgctgagcgaggacaccatcaggctcttcctgcagcagatcgcgggcgccatgcggcttctgcacagcaaaggcatcatccaccgcgacctgaaaccgcagaacatcctgctgtccaaccccgccggccgccgcgccaaccccaacagcatccgcgtcaagatcgctgacttcggcttcgcgcggtacctccagagcaacatgatggcggccacactctgcggctcccccatgtacatggcccccgaggtcatcatgtcccagcactacgacgggaaggcggacctgtggagcatcggcaccatcgtctaccagtgcctgacggggaaggcgcccttccaggccagcagcccccaggacctgcgcctgttctacgagaagaacaagacgttggtccccaccatcccccgggagacctcggccccgctgcggcagctgctcctggccctactgcaacgcaaccacaaggaccgcatggacttcgatgagttttttcatcaccctttcctcgatgccagcccctcggtcaggaaatccccacccgtgcctgtgccctcgtacccaagctcggggtccggcagcagctccagcagcagctccacctcccacctggcctccccgccgtccctgggcgagatgcagcagctgcagaagaccctggcctccccggctgacaccgctggcttcctgcacagctcccgggactctggtggcagcaaggactcttcctgtgacacagacgacttcgtcatggtccccgcgcagtttccaggtgacctggtggctgaggcgcccagtgccaaacccccgccagacagcctgatgtgcagtgggagctcactggtggcctctgcgggcttggagagccacggccggaccccatctccatccccaccctgcagcagctcccccagtccctcaggccgggctggcccgttctccagcagcaggtgcggcgcctctgtccccatcccagtccccacgcaggtgcagaactaccagcgcattgagcgaaacctgcagtcacccacccagttccaaacacctcggtcctctgccatccgcaggtcaggcagcaccagccccctgggctttgcaagggccagcccctcgccccctgcccacgctgagcatggaggcgtcctggccaggaagatgtctctgggtggaggccggccctacacgccatctcctcaagttggaaccatccctgagcggccaggctggagcgggacgccctccccacagggagctgagatgcggggtggcaggtcccctcgtccaggctcctctgcacccgagcactctccccgcacttccgggctgggctgccgcctgcacagcgcccccaacctgtctgacttgcacgtcgtccgccccaagctgcccaaaccccccacggaccccctgggagctgtgttcagcccaccacaggccagccctccccagccgtcccacggcctgcagtcctgccggaacctgcggggctcacccaagctgcccgacttcctgcagcgaaaccccctgccccccatcctgggctcccccaccaaggctgtgccctcctttgacttcccgaagacccccagctcccagaacctgctggccctcctagcccggcagggcgtggtgatgacgccccctcgaaaccggacgctgcccgacctctcggaggtgggacccttccatggtcagccgttgggccctggcctgcggccaggcgaggaccccaagggcccctttggccggtctttcagcaccagccgcctcactgacctgctccttaaggcggcgtttgggacacaagccccggacccgggcagcacggagagcctgcaggagaagcccatggagatcgcaccctcagctggctttggagggagcctgcacccaggagcccgtgctgggggcaccagcagcccctccccggtggtcttcaccgtgggctctcccccgagcgggagcacgcccccccagggcccccgcaccaggatgttctcagcgggccccactggctctgccagctcttctgcccgccacctggtgcctgggccctgcagcgaggccccagcccctgagctccctgctccaggacacggctgcagctttgccgaccccattgctgcgaacctggagggggctgtgaccttcgaggcccccgacctccctgaggagaccctcatggagcaagagcacacggagatcctgcgtggcctgcgcttcacgctgctgttcgtgcagcacgtcctggagatcgcagccctgaagggcagcgccagtgaggcggcggggggccctgagtaccagctgcaggagagtgtggtggccgaccagatcagcctgctgagccgagaatggggcttcgcggaacagctggtgctgtacctgaaggtggccgagctactgtcctccggcctgcaaagtgccatcgaccagatccgggccggcaagctctgcctgtcgtccactgtgaagcaggtggtgcgcaggctgaatgagctgtacaaggccagcgtggtgtcctgccagggcctgagcctgcggctgcagcgcttcttcctggacaagcagcggctcctggaccgcattcacagcatcactgccgagaggctcatcttcagccacgctgtgcagatggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggcaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctccgccttgcccaaggccacggagggcgtctgcagagaggcctgccttccggattccaggcgggcatgccctgcaaaccccgcctgggcctcccttggtctgcccagccctcggttagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgaatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgaaaaaaaaaaaaaaaaa

SEQ ID NO: 4103 - DNA, 2381 bp, Homo sapiens
cgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaaaaaaaaaaaaaaaaaaaaaaaa

SEQ ID NO: 4104 - DNA, 2282 bp, Homo sapiens
cgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaaaaaaaaaaaaaaaaaaaaaaaa

SEQ ID NO: 4105 - DNA, 932 bp, Homo sapiens
gaaagcctgccagcacctattccacctcccagcccagcatggcacccctgctgcccatccggaccttgcccttgatcctgattctgctggctctgctgtccccaggggctgcagacttcaacatctcaagcctctctggtctgctgtccccggcgctaacggagagcctgctggttgccttgcccccctgtcacctcacaggaggcaatgccacactgatggtccggagagccaatgacagcaaagtggtgacgtccagctttgtggtgcctccgtgccgtgggcgcagggaactggtgagtgtggtggacagtggtgctggcttcacagtcactcggctcagtgcataccaggtgacaaacctcgtgccaggaaccaaattctacatttcctacctagtgaagaaggggacagccactgagtccagcagagagatcccaatgtccacactccctcgaaggaacatggaatccattgggctgggtatggcccgcacagggggcatggtggtcatcacggtgctgctctctgtcgccatgttcctgctggtgctgggcttcatcattgccctggcactgggctcccgcaagtaaggaggtctgcccggagcagcagcttctccaggaagcccagggcaccatccagctccccagcccacctgctcccaggccccaggcctgtggctcccttggtgccctcgcctcctcctcctgccctcctctcccctagagccctctcctccctctgtccctctccttgcccccagtgcctcaccttccaacactccattattcctctcaccccactcctgtcagagttgactttcctcccattttaccactttaaacacccccataacaattcccccatccttcagtgaactaagtccctataataaaggctgaggctgcatctgccaaaaaaaaaaaaaa

SEQ ID NO: 4106 - DNA, 10302 bp, Homo sapiens
atggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcggcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagcgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacattggcacagaatttgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcggggccgacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtga

SEQ ID NO: 4107 - DNA, 3539 bp, Homo sapiens
gtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaacgcgaagctgctctcaggggagaacccagaatgcagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgatggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaagagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 4108 - DNA, 4914 bp, Homo sapiens
ctgtcaggtgactctcccgtggcgccatggcggaagcagtggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgccagctaccgaagtcacccagccattcccatgagcagcagttcatttaattgtcacagcgtcgccaggaagaagatctgataaacctaggtttacagataaagaaagcaaaatgtagagatgttgttgaggtcacagaggtgactgcctaacttcagagcagggcttctgatccctttaagaaattacagggccagccgggcatggtggctcacgcccgtaatcccagggctttgggaggccttggcaggtggatcacctgagatcgcacgttcgagaccagcctgaccaacatggagaaaccccatctctactaaaaacacaaattagccaggcgtggtggtacatgcctgtaatcccagctactcaggaggctgaggcaggagaatcacttgaccccaggagacgtaggttgtggtgagctgagatcgcgccattgcactccagcctgggcaacaagagcaaaactccgtctcaaaaaagaaaagaaaagaaaagaaatcatagggccaagttcaaaggaaatgcacagaacatatcttcacattagagttaagaattctctagcaaacaacagatttttttgttgttgttagtcacaaatacttagaactggaaggctctttgttattattgaatgtacccctcagccttctcagcatttccttatcccaagactagtgtgctttctgctacactgctagttttcagttttgttcttacccaattgttttttcttttcaacattaccaatttacagattcagtttattacatttacattaatcctcacttatgatttgagcaagctcatttccagaaaagtttactttaagatcatcaataggatttgctaatttcagtgaagtcattttgcttcaggggtaaattatcctagttaccaagtcctatttggacataaagaaaatcctacttatagaaaaggagaaaataattaaacagtcttcatttttaagtaactgatttaaaaggaaaataataaaatatgttcgtttatcatttcagaaattgctgtaacacactggaaaattcctgaacaatatagattttatcgttaataaaaaacactagctttcgttccttagaatgtcttttcttttgaataaacagtattgggtgatttaaaaaaaaaaaaaaaaaaaaa

SEQ ID NO: 4109 - DNA, 3116 bp, Homo sapiens
agagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtagtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgataagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcatt

SEQ ID NO: 4110 - DNA, 2608 bp, Homo sapiens
actcggagcagcgcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacgttgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaataaaaatattagaaagtaaaaaaaaaaaaaaaaaaaaaaaaaaaaaaaaaaaaaaaaaaaaaaaaaaa

SEQ ID NO: 4111 - DNA, 8256 bp, Homo sapiens
gcaccaccttccatggtcaataatgaacaacgccagcatgcagagcacatattcttatcatttaggaaatcaaaatcaccatttgcagtttgcaagcatattttggaaactagtaaagtggactatgtcctctttcaagctgccacagccataatggaagcagttgtccgagagtggattctcttggaaaaaggtagcatcgagtctctgcgaacattccttttaacctatgtcttacaaaggcccaaccttcaaaagtatgttcgggaacagattctactagcagtagcagtaattgtaaaaagaggatcattagataaatcaattgactgcaaaagcatttttcatgaagtcagccagttgattagtagtggcaatcccactgtgcaaactctggcctgttctattctgactgcgctattgagtgaattttcaagttcaagtaaaactagcaacattggattgagcatggaattccatggtaactgcaaaagagtttttcaggaagaagaccttcgtcagatcttcatgttaactgttgaagttctgcaggagttcagcaggcgggaaaacctcaatgctcagatgtcttcagtatttcagcgttaccttgcactcgccaatcaagtcttgagctggaactttcttcctccaaatttgggcagacattatatagctatgtttgaatcctcgcaaaatgtgctgttgaagccaacagagtcctggcgggagactcttctggacagcagagttatggagcttttcttcacagtacatcgaaaaatcagagaagattcagatatggcacaagattctctgcagtgccttgcccagttagcttctcttcatggacccatcttcccagatgaaggatcacaagttgattatctagcacacttcattgagggattactgaatactatcaatggaattgaaatagaagattctgaagctgtggggatctccagcattatcagcaacctgataaccgtgttcccacgaaatgttttaactgccattccaagtgaacttttctcctcctttgttaactgcctcacacacctcacttgttcttttgggcgaagtgctgcattggaagaagtgcttgataaagatgacatggtatacatggaagcatatgataaattgttggagtcctggttaactttggttcaagatgacaaacatttccataaaggcttttttacccaacatgcagttcaagttttcaattcctatattcagtgccacctagctgctccagatggcacaagaaatttgactgccaatggtgtggcctctcgtgaggaggaagaaataagtgaacttcaagaggatgatcgagaccagttttctgatcaactggccagtgtaggaatgctaggaagaattgctgcagaacactgtatacctcttctgacaagtttattagaagaaagagtaacaagactccatggtcagttacaacgacatcagcaacagttacttgcttcaccgggttcaagcactgttgacaacaaaatgcttgatgatctctatgaagatattcactggcttattttagttacaggctacctcttagctgatgatactcagggagagactccgctaatacctccagaaataatggaatattccattaagcattcatctgaagttgacattaatacaacacttcaaattttgggatctccaggagaaaaggcttcttccatcccagggtacaacagaacagattctgtgattaggctgttgtctgccattctcagagtttcagaagttgaatctcgagcaataagagcagatctcactcatctactaagtccccagatgggcaaagatattgtttggtttttaaaacgctgggcaaagacttatctcctggtggatgaaaaactgtatgatcagataagtctgccattcagtacagcgttcggagcagatacagagggttctcagtggataattggctacctcttacaaaaagtcatcagtaacctctcagtctggagtagtgagcaggaccttgcaaatgacactgtgcagctccttgtcactttggtggaaagaagagaaagggcaaacttagtaattcaatgtgagaactggtggaatttagctaagcagtttgcaagccgaagcccacctcttaatttcttgtcaagtcctgtgcagaggacattgatgaaggctctagtcttaggaggttttgcacatatggacacagaaaccaaacagcagtattggacagaggttcttcagccacttcagcagcgattcttaagagtgataaaccaagaaaacttccagcagatgtgtcagcaagaggaagtcaagcaggaaatcactgccacactagaggccctgtgtggcattgctgaggctacccagattgacaacgtagcaatcctgtttaattttttaatggacttccttaccaattgcattggattgatggaagtttacaagaataccccagagactgtcaatctcattatagaagtttttgttgaagttgcacataaacagatatgctatcttggagagtccaaagctatgaacttatatgaagcctgccttactttgttgcaagtgtattctaagaataatttagggcggcaaagaatagatgttacagcagaagaagagcaataccaagacctgcttctcattatggaacttcttactaacctgctgtcaaaagaattcatagatttcagtgatacagatgaagtgtttagaggacatgagccaggtcaagcagcaaacagatctgtgtcagcagcggatgttgtgttgtatggagtaaacctaattctgcccttgatgtcacaggatctcttgaagtttccaaccctttgtaatcagtactacaaattaatcacatttatctgtgagatttttcctgaaaaaataccacagcttcctgaggatctgtttaaaagtctgatgtactccctagaattaggaatgacatcaatgagttcggaggtttgccagctttgcctggaggccttgacaccgttagctgaacagtgtgcaaaagcacaagaaacagactcaccactttttctagcaacacggcactttcttaagctggtttttgatatgctggttttgcaaaagcacaacacagagatgaccactgcggctggcgaagctttctacacgttggtgtgtttgcaccaggctgaatattctgaactggtcgaaacattactatcaagtcagcaagacccagttatttaccagagattagcagatgccttcaacaagctcactgcaagcagcactcctcctacgctggatcggaagcagaagatggccttcttaaagagtttagaagaatttatggcaaatgttggtggtctcctttgtgtaaaataaacaacagaactttatgcttaatttagatcctttctgcaaagtgcactgaattgctgaaagttgacttgagtcttgtcctattcctcagttcatttggccattttggattttggagagcctgaaactttgatatgtatgtaatacagtgaaacaggagaggtcaacttggcatcagcttctgctgttaagtgttagccacaatctgtcatatatatgtcttttagattctgaatggtgatttaaaattttcaaaatgaaattccatatatgtgcaaacagatatgggcaccacgaaatacatatgcagtgccttttttccttttaacataggtggctagccaaagtttagaatttttgtcattaaatatgaaatggatatatgctaggcagtgtttctcaaaatctccatagatcgcctgcatcacttgaggagctggtgaaaaggcagattcttaggcccaactgtagaccttcagagtcagaatgtctggttgttgggcccaggagtcttcatgttaataagcttctccctttcgtcaccccaaaagttttgaatcaatgaaagagacattgaaaactcttaagaggttttgtgctttctagcttttcctccctttgatgattgggttttataattcagcaggaaggggaaacatcaccaggggtttgttggctttttcttagcttgctttcttgcttgcttgctttcttgcttttcttgctttctgtctctctctttcttttctctctctctctcacatcaacccagtgctgcaggttttgtgtaatacaagtcactaatcatactctgatgcctgaacttgaggaggaaaatacatgtatatttttgttccgtaaaaataaccttaggaactgtagccatttcattgccttaattttaagaggaaaatacaaaaacagctgatttgttttagtaagaaaccacgtcttgatgcttcagagttggtttagggtgttagctgctatgaacctgttgcccctttcgatcgtgtatttatgtaggtttatcagtgaaatgaaaggcttgtttccgtctagtctaactttttgagtgtgtttctatccagccacatagcccatatctactctaaatggcttgcttaagcaataattattttaaaggatgtgaatcactgattcacacagactattgcacgttggggcattaggggcaataattcttatccagacatgggagccagtgaatttaatttcagagattaaaaattcactttagatcctctagtttgatctcttaatcaggatttttatacagctgccaggctcccctaattcagtgtgccagcttacaatgtggaaatgaaagctaatttatacacagcaggcatatgaaactccactcattgcagtactttcacagcacagtgacaggtagaggactctggcacaggtgcactcatgaaactctgcttccaccatgttcctgacacctatctattaaaccattctgcaaatacggtttttctacctgattgcatatagcatatgtgtcattacatgtgatgctgtgcaaaactttgtataattctgtgttattaacagttaacaaaactggagcatctgaattacatccaacctgtgcatgtgatgttaggtagatgtgaatgcagggccttgggccataacttacatttctctcaatttgattagctttgagtcacaattaaggggaagcaaaaacatcttgaaaagactgctaggaaggaaattaatatcagtcatccagaagtacacgtttctgtattttaaaaaatactttgatgcatttatttttaggtgttttttttttccccttaaaaaacttgaagtgatatgcagcagtaatctatttgttttgcattgttcttggtgttttgtgtttcccagatccctcaagctttctcagctgttgcgaattatgtgtatctgtgtgtgtgctaagtacagtctctttaccaaagggcactgaaacacacaattgactggacaggtccacgcgccatgacaaaactataatcaagttattaaaactaaagaggagtgggaaaggaatgccttggtaagtaaaaaggcatctatatttaataacttttatccagatggcaacatatttgcaaaatttgcccagatcctattacaatactaaaaatagaaaatttcacctccatattcctgaggtgtaatttcattagactagttttagtttaaaaagaccttcttcagattggaccaaataatacttataagatcagcagaatgttgaatattagctcactggggtggggagaagccactaccattttttaggtgatggggatgccactgagttgcaacggctagaccttttcagggtggttgtgtccatgtttgcctgattggatgcttattcactttgtgttttcttttgttttattttgtccaattttgtctttagctgtgtttattaacttctccggtcttgttttgttttaatgctcttggcccagtgggtgtcaagaacactggcttaattcaagtcagttgattttttttctattaaaactgttgttaaaatattttttaaaacaaaaacattatttgtgccctcttttatatatgtcaaagggacactgtcaagtatttcatttttagatttttgttttataaaatttctgttgttcatatagtatcctttaacctctagttttccatacatcctttgtttgtttctcattttattttccttgacccatttatttcccaaggcacaatcactaaagactttgtactttcacagtctgttaatgtggtagcacctgtaactgtgttcttgttctgttaaaaggattgatttgcttttatagtccttgtgctggatgagtggctgcctcagtagcaaaactacctgacagtatttgacagtgtcctttccagcaccattatttgggtctttcagggtggccatctctgttagaagacagtagcatgttaacatcactgcattgagtttttgtctggtgtaaagtatgacttttaatgtaaacaaactgcaggtttttttcaaactaattttaagaatttagtcttatttcgttgtaaactgtgtatctaattatattacattactctgttcagatgggatggttactaccacttgtccatgattttcatttgaaaagcaagtatctatatcatttccccccagtcagcattatttaacactccccttaactgtctttgaactttctcttttaacaaaaatgtcaagtctttatagttgtaatatcaccatgtttcccatttctgttaatacttctatgaacccctaaagtattgaagggaactagctgtcagtttcaaggattacaagtttgagtctcctagtattcaacatcattctgaaccctgaaataatatttttctctgttaaacaatttttatctgtttgccacctctgttgttagaggtggttgtcaattgaccttactaagttagctgtctttgatgaggaattattgttattggttcctgaataaaacattaaccttttaagtcagaaggaacctcggtacttcttaaggtttgtttgtgttttctaaaaccagagaataaggaactgatttggctatgaggtttaacattataattttctgtaagctttcccacaaaaaaacattgttgatttgaggatataataatgttttaatctttttaaaatataagtggttattctctgacttggtaactatgttctgaaaacactgcatttaagaatttttaaaaattggttttctaaaattaaaatgtccaaattaggcatattgctgagctcaaattgatgtgaaatgccatggttccagttgaattttaagcatattttcatttagatataaaatatatgaagtatgctttgttgattatagtgagaacccatgacatagttaaccaaagaatatgtttggttcaaataaaaatagaagcttaatactgggcattcatactttttaaagagaatgaatgaagaaatcggtttcctgctgtagttctctatgggtaagtcttagtaaagacgagaatgctgaagtcggccgtggcgattccctcctaggaactgggaggtgtggcttgcccattacccgcttgaagctcacatctttaccctcctctcccactgtggtttgatcttcacctattcccaggccctcccagcaattggagaggtgtctttttttttggttttggttttttttctccccgtctgcattcttaggcctcttagctattaggaactgtcagatacatactagtagctaattttcctagcctgaaattatatactgcatctgcactatgtacctactagggatctgacctcaagtgttttctgagcccaggcttcctggtgtggtgtcttttaccacataaaattattacaaattgcaaatgttggtattgtgatttgattatctgtacaaagaaagaagctctatgcagtgagtttgtggtttaatggtcacaaaaatgttagcactgctaccactcagcacgtgtaaaattttttaaatttataaatattaaaattttaaacttacactaagacttttcagttttatttaaagacccagggatgagtgtactgtttaaatatttacctctattaacataactaatgaaggtataaaattgcatttagtttttcagaagatgctgcaatatgattttaggaaataaggctatgtattgagccagttataggctgaatatcaggttgataaaattttatttgtatttttaaaattcataaatgggagttaaaatgtgtcttttcactaaatatttttattacaaaaaaaaaaaaaaaaaaaaaaa

SEQ ID NO: 4112 - DNA, 3000 bp, Homo sapiens
gacttccggcggaagaagaagccggtccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtgaagatgatctaagaaatgtaggaccagtagatgctcaagtatatcttgaagaaatgtcttggaatgaaggtgatcactctttttatctgagttgcagatgtggtggaaaatacagtgtttccaaggatgaagcggaagaagttagcctgatttcttgtgatacatgttcactaattatagaactccttcattataactaaaattgttcacaacttgaaatgctttaactgtggtattgagacatgatgagaagccgttgagctttgtccattcaaggaaatggattatttgtcagcccgattatttgcaaagaaaatatacaattatcaagcagagaccacctcagattaatagagaatgaatataattatttatttgtatttataatttatatttacaagttgtcacaaaaatagatttgattatatttggtgaattcccatctgagaactttattatgtcatttttttccatgacacaaaataagaattttcttaatatgagcatgtctcctcttttcagtgggtaacagtatcatcatattcctttatagttactaagtttctggtctaaccgataacgtttctagttgctaaagttatggggctgttgtacacctagaatctttgtgaataatgtgaggccagttcttccataaggaaggctggttatggatattcataaggttatttcaaagttaataaagacaaagtggcaactgtagaaagtgttgcctccaatcttggtccgtatttccaaagcttgtaaacactgccatcttcaaatttaaatgtaatttaggaaatggaagcttttaattttaatttcttttttctaagacagagtctcactctgtcgcgccagctggagtgcagtgccatgatctcaggtcgctgtaacctccgtctcctgggttcaagtgattctccagcctcagcctcccgaatagctgggattacacgtgcccaccaccatgcccagctaatttttgtatttttagtagagatggggttccaccatgttggccaggctggtctcaaactcctgacctcaggtgatccacctgcctcgacctcccaaagtgctaggattacaggtttgagccaccgtgcctggcctaagttttgttaatagagatgggatttcatcatgttggctaggctggtcttgaactcctggcctcaaatgatccgcccacctcaacctcccaaagtgctgggattgcaggcgtgagccaccatgcctggccagaagcttttttaaaaataatgacttggaagttggtgcattatttccccttttattttggagtgttgatataatattggggccaggcatggtggctcacatctgtaatcccagcactttgggagactaaggcaggcggatcacctttggtcaggagttcaagaccaccctggccaacatggtgaaaccccatatctactaaaaataatttttttaaaaattagccagtcacgttggtgtctgcctgtggtcccagctactcgggaggctgaggcacaagaatcacttgaacccaggaggcagagtgagccgaggttgtgccactgcactgcagcctgggctacagagagcaagactctgtctcaaaaaaaataaaataaaataaataaaaaaagatatagtattaatgcctgtatttatgaagacagggccattgcactgctgctatgctgaaatgaacttttataaagtattattgactatagccaactacagatggcatatgccttaaagatgcatttttctatgtatttaatattttgtgtacagtaaaagtcagaactcatttaaagaactttaagggatcctttagaaacatttttacttaatttcaaatgagtgggctgagcatgtagactagcagctttttatcaaacctggcattgtcaggttgaacttataaatacgaatagttactactctgacttgtaaatgtagctgctaaagtatgaggtatatttaagaagaatagattagtttcattatacctataagaacaagaattcaaaagtgaggtagtcatccaggttccccctcccacaatatttttgtatcataaaatttagatgacttttttgggttacatttttatccatatattttgaactaacagaacttggcagaatgtgtgttgaatattctttacatttaacaattaaaaacaactaaaactgaatagcaaatagtttattggtaagtacacggtttcaacgggagtaataaattcacatgaaaaggagacaataatcaagtcaaaagaataaatgcttactaatcatcagaaaatctgtggccattagggctggcacgtaaaaatccaaaatcactcagaggccaaatctgtaaaatcaaaatgaggttgaagacaattagtgaaagtaatgttatagtatcatcatattcccttttgctatctgtcccttttctctatgccagataaacactttctccttactcatcaatcaagaataaaattttctacatcaaagtaagacttgagaaaataaacttatgtgtatatatgtttaaactccaaagtttgggacattcaaacaatgtacatgaaattatatgtgtgtggtgtgtgaataaatatgtatgaatata

SEQ ID NO: 4113 - DNA, 1816 bp, Homo sapiens
gtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagataaaaaaaaaaaaaaaaaa

SEQ ID NO: 4114 - DNA, 1768 bp, Homo sapiens
gtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagataaaaaaaaaaaaaaaaaa

SEQ ID NO: 4115 - DNA, 1699 bp, Homo sapiens
gtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagataaaaaaaaaaaaaaaaaa

SEQ ID NO: 4116 - DNA, 1581 bp, Homo sapiens
gtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtgggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagataaaaaaaaaaaaaaaaaaaaaaaaaa

SEQ ID NO: 4117 - DNA, 1973 bp, Homo sapiens
ctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggtcttttgtggggatgagccagggtgcaaggagagtacaatactccagttaccgaattgaaaccatccctgcagtggagcagcctcctccagtttctgttgggttttgagctacctgttaaataagtcagtgggattgtcaaggacaaagccctccctggctgcctcagggcaaaatcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagataaaaaaaaaaaa

SEQ ID NO: 4118 - DNA, 3163 bp, Homo sapiens
gcgcgcgccgccgctgccacctccgctgctcggcccggtcccggagtggcccggccggcccgcggggcgcggagccgaggcccgcggctggctgcatgaaggactgcgagtaccagcagatcagccccggggccgccccgctgcccgcctccccgggggcgcgccgtcccggccccgccgcgtccccgactccgggccccgggcccgcgccgcccgccgcccccgccccgccgcgctggagcagcagcggcagcggcagcggcagcgggagcgggagcctcggccgccgcccacggcgcaagtgggaggtgttcccgggtcgcaatcgcttctactgcggcggccgcctcatgctggccggccacggcggcgtcttcgcgctcacgctgctgctcatcctcaccaccaccggcctcttcttcgtctttgactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctgaccacggctcagtacttgccacctgctggcctgtctgaccctccgcactcacctgccgggaccctccctattccatccaagggaagcagaactgccaaagactcaagtcttttcatatttatttcccatcctgcgtggctttccctgaactgttccgtggctgtgccctctgctccccaaacccaggttcccacagccttgggccctaggtaccccagctgatcagtgccaggagagaccagagcctctggaggctacccaggggaccacaccaagtccttgcctgtgccgggcgagccctgtgtgagtgaggctgtgaactgagcgtgaggcctcccaggtgggggaactgcttgggccttgctgagccagggtcctcagggtgaagcaggactgaggagtggccagctctggatagctggctgtggagaggaagcctccatgggctgctttggtctgtgggctccttcattcccttggtgataatttccctttcttctgtgggatttttggtggggttttccccccttttttatggagttggccaataggattgagttggggctccagtagagaaggcagggttggtggtgggtgggggcagcctgtatcagacaaaggtaaatcagccagccaggcacccacagcctcagctcctgtgcagttcctgggcagcacagtggaagtgggagcctggtccttcccctgcccatggagagctctttaagggatcccagcctgcccctccacttctctcccaagccaggtcccggcatgggtgggttatgctcatgctggcaatacttgaaacgggtttattaatgctgggtattttgcacaattttatagacctcttttctacatagtcttttttaaatggaaggagaaaatgtcagccacattactgtctgtgtagtgccaggtgaagggttatcagaaggctggttggttttaataagtttattccaagagaccttctggctggaatgagtgagagtgtgtgtgcatgtgtgtgtgtgttcatgtgtgccctgtatgaatgtggctggctcccatatcccctgggctgccccctgccccatcccctttgagtatcagaagcactctgagccaaggggacagggggcacgtgcactggtcacgagaaaaccctgggctcccactggggctcagcccagcctcctatctttccttcttctatggacttcagacagccagtgtctggggactctgccactctacccccagccctacccaccagcccccaggtgaggcttccagctgggacctgcccagacaggctgagcctgggcgtggtgggtggggtgatggctctggggagcggctgccatcctacaagccacaccccctcctctgagctctgaatatgggacccagtgccaggagctggaagacaaggtgtttctgccaaacggggacctccatccagagaaaaggaagaaggtgcagggtgggccaagaggcaagtgaaggttggcctgagtctgggccggaaactcagaggatgtttctcctctgctgggagctgtagtttcttatcaaaatagatattgttccaccatccccctccttggcccttcaagtgggctgaagcccttggaaagtgacataggaagtccccagatcttgcccttctcactccagaggctagtggtcacagacagctgggaatggcagccacagagggtcccctctgggagaaacagcttcaccccagcctcagggccctgggccatcactgcagtggccctgggaggtgaggaagaagctggctagaggagggggctcccacctaccttttatttaagccagtattctttgttcctgcttgtaataaaacttcagtttataagaaaaaaaaaaagaaaaaaaaaaaaaaaa

SEQ ID NO: 4119 - DNA, 1793 bp, Homo sapiens
acggcgccggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgctcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatctcaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaagggaataaatttggaatgctc

SEQ ID NO: 4120 - DNA, 3005 bp, Homo sapiens
gacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatatttttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctggactgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtgggcctggttgccccatgttaggaaatcactaccagtcaggtggggctggggctgggtggacaggatcaggattcccttgaaagcccaggcagggtgagcagtcccagtggtcctagtgccgcatcagatccaggtgggtgagggcaggaggcccctgcgaaggcagcgtggatctgcccacacataggctactggaatagtttaacccagcaactttcctttttataaaacaacaaatggttcaactctgtctgcaaattaacagctgaacacctgcaactgcaaatgttttttgatccgacgtactgaaataggaagtcatgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggccatcctcagtgaggcagccccccataggcttccgccaagctctggtcccgaagaggctgtgcgagcccttcccggccctccccagggccccccgccccctcctctgcctgctgcgtggaggcagccatgggaaggagcccaggggagctggcctgggggagcgaagcccatgttcgcttcctgacttagagctggggggggtggggggtggggcttgttcccctgcagtatctgttctgtgaagtttgttaaatgtaaggaaagcttaaattcttgtatctttaaaagagaaaatcttatttaacccttttgtgttctagatttacttacacacatagcctagagctcagttttagttttaacattgtgaaaatattaaaagaatcttgtaactttattcttttttctcctgctgaaaaaaaaattaaaccaatcgtatg

SEQ ID NO: 4121 - DNA, 1539 bp, Homo sapiens
gtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgctttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggcgctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaacttcttatagaaaagacagatccaaatatggccacagatgaacttccatgcaagctatggctgagtttcattgcttaaaatgctcctctgtttagaggggcctggtagaaataaaaacccaccctatatcttaaaaaaaaaaaaaaaaaaa

SEQ ID NO: 4122 - DNA, 2264 bp, Homo sapiens
ccgccctggaggccggagccactgggcctgcgcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttgccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggcgctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaggcccccagaatgagaagtgacaacaaggaaaatccacaacaggaaggggctaaaggagcaaagccatgtgcagtgtcagctggcagatccaaagggaatggtctgcagaatcctgaaccaagaggggcaaatatgagtgaacctcggttgtcacggaggcaggtcagctccccaaatgctcaaaagccatttgctcactaccagagacattgcagggtggaatacatcagcagccccctaaaaagccacccactgagagagctaaagaaaagcaaaggaggtaaacggagtctgagcaaccgtttgcaacatcttggtcaccagcccacccgctcagcaaagaaaccctacaaatgtgatgactgtgggaaaagcttcacgtggaattcagagctgaagagacacaagagagtccacacaggagagagaccctacacgtgcggagagtgtggaaactgctttgggcggcagtcaaccctgaagctgcaccagaggatccacactggagagaagccataccagtgtggccagtgtgggaaaagctttcgccagagctcaaaccttcaccagcatcaccgacttcaccatggggactaaaaggagcactccatgctttagattcacacggaaggtgtttgtgtttctcctcccccttgcttgcatgtaaatcacaaaaactgtgtgacttacaaggaaagcacgaggcccttgaggaatgatgatgcacattctgctgtgaggaggcccagaaaaggccaaccagggcccaaccgtgcatgatgacagggtgcagagaaggcaggtctgggcactggggcaaagagaacttaagtctctgcagagagcaaggagtaactactgagagagaatcaggacaatcctgcaggtggcccgcttactgttaaatcgtccctctgttgctttatcctctaaaatatgttaagggataaattctatatatatagttatgcatttgctgtcataccagacaattttttatcatgagcacacttctttaataaagatgagtgatctaccagaaaaaaaaaaaa

SEQ ID NO: 4123 - DNA, 5165 bp, Homo sapiens
gggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgggtgagtgtgtgtgtgtgtgtgtgtgtgtgtgtgtgtgtgtgaataagccagaggctgcctggtggggccccgccgtggcccagtgactgagataattgtcttcgtctgtgaggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctggtggggtctgcagaggtggcacggccaggacgggtctccgtgtctctgaaatgtgcctttgcacttctgtcaggttgacagggacaggcagtgtctctctggtgtgagcgtctgtgggtgtgaaagggccagcgagtgtgcggctgtgactggtcgggatcgggcctggatgcatggccttttgagtgagcacaggtgtgtgcgaccatgtcacctgtctttctagtgtctccgttgcttcctgtgccttggccttccagccatgtggtacctgctagggagcagtggtcccaaagtgacgtgagaggctgtacgctgttgtgaaaatgaccaagaagaaggcttcacaagtcacgagatggcagttttggagccagaagtgctctccgtgcacactacctggaggacaagaggaagtaacctcaagaatagaattccttttggggaagaaagagctggccttcaggaaaagcatcccggaggaggaagaagaagtgttatacgtcctaaagtaaggtttcaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaaggcctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagagtgtgggaaggccttcaattgtggctatcacctcactcagcacgagagaatccacacaggcggaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaaaagaaaagaaaaaaatcatatactgaggttgctaagatctacatgacaataagatattttgggagagagatacgttcacataattttattacatatattgttacaattgttctattttgttagttactgttggtaatctcttactgtgcctaatttataaattaaactttagatatgtatgtacaggaaaaaatgtagtatatagtatcgtatatatgtacaggaaaaaaacgtactatctgtggtttcaggtatccactgcgggtcttcgaacgtacccccctcaggtgagaggggactgctgtacaaagaatataggaaggcctctagactacatccattccttcctcaacaggaggaaaattcctggtacagtttaacgtaaggcttcactgatcactgttgtttttgtttttgtttttgtttttttgagacagagtctcactcttgcccaggctggagtgcagtggcacggtcttggctcactgcaacctccacctcccaggttccagcaattctcctgcctcagcctccccagtagctgggattacagacatgcaccaccacacctggctaatttttgtatttttagtagagacagttttcaccatgttgtccaggctggtctcaactcctgacctcaggtgatccacccaccttgccctcccaaagtgctaggattacaggcgtgagccactgcacctagcccactgatcactcttctgcttacagaatatcagaagtcattctagaggcaaatttgaagagtggaaaaatcactttttctgaatgatcttgtttttggtgtagatgtttttattgtgtgggttagtttaatgaatacataaagactaccagtaccattctgtctttactccgtggcatctgtggaataaccctgctaatgtaacacgtgagaaagcctttggtcatgccacccactctaccagttgtccccaccatcccccgccctcctccctgtgagacactgggccaaaggctcactacccctgtgcgttgtccagcacacagacactatgtgcattatttgtacataaggataatcacatctacctgagactgctatcatggaaattaaatgtttggtacatgtaaagtctttgaaagtgtaactggaatattgtgtaattttaataaataataactattgttgtttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgagcaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4124 - DNA, 1439 bp, Homo sapiens
gtggcttgcagctcggggtgggtggctcatttcctggccgctcctgggcttcgcggaaagaagagattactcacactccttcgcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgattgtgagaacagtgaaacagcaacaaaagagggcatctcagaagaaaaatcacagggactccctcaggaaccttcatttcgaggaattaagttgtccagacctcccaaagcttcttcagctatccgttgggaatgtgtttctccaggaagttttcccggcgatatcatagctgctgaggctacacattcaacaatttcttgctttgccatcaacactttgccagccaccatcctgccatctaaaaatgtgaatagaaagtatttttcctgaagaacacatcgtcaataaatcacctgcacccaaatctccatctcaggcgctacttctggcaaggcatatcatgaggctagtgaagcacctacaagaaacttataactcaaggttgtaaaaatggcatggtgactcttacaatcatatcacagtgggcctctccaacaatttaaacctcatgacctaggtgaaagctgtgaaaggatccacattaattcttcagaggcagggctaagactttcaagactgaaaagagactagcataaggagacttaacaggaacccagtcaaggccattcatggccatgggaccacgcataaatggagaacgagtaaattttgctaagtccaaggacattggagagatagagtcactattactgatatggtgactgagtcaacaacatactgccactatgaagtaataagaaaataaaaagttaaaaaatgtaacagaaaaaaaaaaaaaaaaaaaa

SEQ ID NO: 4125 - DNA, 4895 bp, Homo sapiens
gagcgtggctcaccgggcccggccggaacctacgggcacagctgcgggtgtgtctgcggaacctccacctgagctgtagagtgtttccctcgacccactagtctgggttccacagggtctgagctcctcagaggtgggagctgcggccgagggaagggtgcatgtgcgcggcgacaatcgggcctcttccccaggcagcttgtgagcccctctccctctccgccctcgcccaggctgctccgatcttcgtttccttgcctaggctcatacacccaggctttatttagggccaaagtatccgtcataacctcggttttctgtctcgcaagtatcttgccgctcaatttgtgaccctgaagctttagtgagtcgctctgtgctcactatttctggtcttttcagaggatggcttcactttcaatggaattgcccgagtaactgccctgtgttgtcacgtaaacaagtccttttaaactgagtctgtagttgtcctgtgttgagtgttttcttatatcaaaaactttcctgaccaagaacaaaaaaggagctcaagtaaaatcacccatttgcctagaccccaactggagagaacctttgcctgagctgtctaagctcgggatggaagcagtctctagggtcttcccagccttggctggccaggctccagaagaacaaggggagattatcaaagtaaaggttaaagaagaagaccacacttgggatcaggaatcagccctacgtaggaatttgtcttataccagggaactctctcgtcagcgcttcaggcagttctgctatcaggagacacctgggcccagggaggctctgagtcaactgcgggaactttgccgtcagtggctgaacccagagatacataccaaggagcagatcctggaattgttggtgctggagcagttcctgaccatcctgcctgaggagctccagtcttgggtgcgggagcataatcctgagagtggagaagaggtggtgactttgctggaagatttggagagggagcttgatgaacctagacagcaggtctcacagggcacatatgggcaggaagtttctatggaagaaatgatccctctggattctgcaaaggagtctttaggcacccagcttcagtctatggaagatagaatggaatgtgaatctccagagccacacccacttcaagataatgggtcatttttgtggttttccatgatgtctcaaagcatgggtggtgataacctcagtagcttagatactaatgaagcagaaattgaaccagaaaacatgagagaaaagttcttcagaagcttagcaaggttactggaaaacaaaagtaataatactaagatattttctaaagcaaagtactgtcagttgataaaggaagtgaaagaagctaaagctaaggcgaaaaaggaatcagttgactaccgtcgcttggctagatttgatgttatccttgtacaaggaaatgagaagctaattgaggctgtaaatggggaaacagataaaatacggtattacttacacagtgaggacttatttgacattctgcataatacacatctcagcattggacatggtggacgtactcgcatggagaaagagttacaagcgaaatacaagaacatcacaaaagaagttataatgctgtatctgaccctctgtaaaccatgccaacagaaaaattcaaaactcaagaaggttctaacatcaaaatcaattaaggaagttagttcaagatgccaagtagatcttatagacatgcagttgaatcctgatggggagtacagatttattttgcattatcaagatctctgtacaaagttaacttttttgcggtcattaaagtctaaaaggcctacggaagttgcacatgctcttttagatatatttacaattattggagcacccagtgtcctacaatctgacaatgggagggaattttcaagccaggttgtcagtgaactcagtaatatttggccagaattgaaaattgtccatgggaagtctcagacctgccaaagccagagttctgcagaacaaactgaggatatccgaaagaggattttctcctggatgcaaactaacaactcatcacactggactgaatttttgtggttcattcagatgtcccaaaatcagccctatcacagaagcatgcaacagactccatgtgaaagtgcatttagctctgaagctaaactgggcttgtcccattctcagctaactgaagaacttgttgccagcttgcatacagaaaatgaattagatcaggctgacaaagagttagaaaatactttaagagcccagtatgaagaaaacattgagactggaacagacagtagtgatattgaagagaatctttctgtcactcctaaggtggctgaaaaaagccctcctgagagcagactaagatttttatcctgtgtagtttgtgaaaaagaatgcacaggtgttaatagttgtatatcatgtgatggaaatatccatgcaatttgtggagtgccctctcaacatgggactgagggctgtggtcggcaaataacttgtagcctttgctatgaaaccagcacaatgaagaggaaacatgatgagattcaaagaagtttgcctgttaaaccttccaaaatgctaaagccatcagggacaccattttcaccagacaaagtaggagactggatggcgaaacaagcttcactggacttttttgtcaagaaaagacatgccttttctgaacacagtagtagtaataaaagaaatgttaacaatagaagttatcctgaagaagggaaaaccaaaagagttcatgctagtttcactcggaaatatgatccttcatatattgagtttggttttgtagctgtaattgatggtgaagtactaaaaccacagtgtattatttgtggagatgtactggctaatgaagcaatgaaaccatcaaaacttaagcgacatttatattcaaaacataaagaaataagttcacaaccaaaagaattctttgaaagaaagagtagtgaattgaaaagccaaccaaagcaggtgttcaacgtttctcatataaacattagtgctttgcgggcttcatataaagtagcacttccggttgccaagtctaaaacaccatacacaattgctgagacactagtgaaagactgcatcaaagaagtttgcttggaaatgttgggtgaatctgcagcaaagaaggtagctcaggtaccactttccaatgacaccatagctcgacgtattcaggaactggctaatgatatggaagatcaactcatagaacaaataaaactagcaaagtatttttcattgcaacttgatgaatgcagagatattgctaacatgataattcttttagtctatgtgaggtttgaacatgatgatgatataaaggaagagttctttttttcagcctctttgcctacaaacacaactagctcagaactgtatgaagctgtaaagaattatattgttaacaaatgtggtttggaatttaaattttgtgtaggagtatgttctgatggtgcagcttcaatgacaggaaaacattctgaagtggtaacccagattaaggaacttgcgccagaatgtaaaacaacacattgcttcattcatcgagaaagtcttgccatgaaaaaaatatcagctgaactaaatagtgtacttaatgatatagtaaaaattgtgaattatataaaatctaattcattgaattcaagattattctctttattatgtgataatatggaagctgatcataagcaactgttactgcatgctgagatacggtggttatcacggggaaaagttctgtcaagaatgtttgaaatacgaaatgaactcttagtgtttctgcaaggcaagaaacccatgtggtcccaactttttaaagatgtgaattggacagccagacttgcttatttgtctgatatcttcagtatttttaatgatcttaatgcttctatgcaagggaagaatgcaacttatttttcaatggcagataaagttgaaggacaaaaacagaagttagaagcttggaaaaacagaatttctacagattgttatgacatgtttcataatttaacaacaattatcaatgaagtaggtaatgatcttgatattgcacatctgcgaaaagttatcagtgaacatcttacaaatttgttagaatgttttgaattttattttccatcaaaagaagatccacgcataggaaatttgtggatccaaaatccatttctttcatcaaaagataacttaaatttaactgtaactctacaggataagttgttgaagctggctaccgacgaaggattgaaaatcagttttgaaaatacagcatcacttccttcattttggataaaagctaaaaatgactatcctgagcttgctgagattgctttaaaattgctgcttcttttcccctcaacatacctctgtgagaccggattctctactttaagtgttattaaaacaaaacatagaaacagtttaaatatacattatcccctgagggtagcattgtcatcaatccaacctagattagacaaattaacaagcaagaagcaagctcacttatcacattaaaagctttaaatattgatatgtaaggtattggttcaaagtatgcatataagcattgagtgtgaggaatttgctatttcactttaaactttctgtctagttacagttatggaagtatgagaagttatgagtgaaacagcaattttctatataaattgcctatatgtatattttcaattaagaatgtgtacagtttttataattctatttttcctcatatttgtcgtatttattaaaatataattttaaatctgttgattctaatattaaaacatttgatcttaaaaaaaaaaaaaaaaaaa

SEQ ID NO: 4126 - DNA, 5154 bp, Homo sapiens
gttcgcagctcaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggttatcctttacggttctccacactctttcaggagcagcagaaaatgaacatatctcaggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaaaagattacagaggtgatgacctgatcaagcagaacaagaaaatcaaagacaaacacttggagcaagcaatatgtatcaataataaaacattgactacagaggaagagaaagttttggggaaaccatttactctgcatgtagctgctgttgcttcaacaaaaatgtcctgcaaatgcaactcatgggaagtgaatttgcaaagtatttctgaatttatcattaataatagaaactattcaacaaagaaaataggttgcggtaatgtatgtgagaattcacctttcaaaattaactttgagaaaactcagactggagagaaattttatgaacataataaaaacatgaaagctctcaattataatgaaaatcttcccaagcatccaaagtttcaaactttggagcaagcttttgaatgtaataaaattggaaaagcctttaatgataaggctaactgtgttaaacataacagttctcacacaggagaaacatcctctaaagatgatgaatttaggaaaaattgtgataagaaaactctctttgaccacaggagaactggcacagggaagaaacacctgcatcttaatcaatgtgggaaatcctttgagaagtcaactgtggaggaatataataaacttaatatgggtataaaacattatgaattaaatccaagtggaaataatttcaacagaaaggcacacctcactgatcctcaaacagctgtcatagaagagaacccattggtaagtaatgacagaacacagacttgggttaaatcctctgaatatcatgaaaataagaaatcctaccagacgtcggttcacagagttcgccgaagaagtcactcaatgatgaaaccctataaatgtaatgaatgtgggaaatccttctgtcagaaaggacatctcattcaacatcagagaactcacacaggagagaaaccatttgaatgtagtgaatgtggaaaaactttctcccagaagtcacacctcagtactcatcagagaattcatacagcagaaaaaccctataaatgtaatgaatgtggaaaaacatttgtccagaagtcaaccctcaggggacatcaaagaattcacacaggagaaaaaccctatgaatgtagtgaatgtgggaaaacttttgttcagaagtccaccctcagagatcatcacagaattcacacaggggagaaatcctttcaatgcaatcaatgtggaaaaacatttggccagaagtcaaacctcagaatacatcagagaactcacactggggagaaaacttaccagtgtaatgaatgtgaaaaatccttctggcgaaaagatcatctcattcaacatcagaaaactcacacgggagagaaaccattcaaatgtaacgaatgtgggaaaacttttgcccggacatcaaccctcagagtgcatcaaagaattcacactggggagaaaccatttaaatgtaatgaatgtgggaagaaatttgtccggaaagcaatccttagtgatcatcagagaattcacacaggggagaaaccctttcagtgtaataaatgtgggaaaacttttggccagaaatcaaacctcagaatacatcaaaggactcacagtggggagaaatcttatgaatgcaatgaatatgggaaattatgtaagaagtctaccctaagcttataccagaaaattcagggagaggggaatccctattgatgtaataactagaaaatccttttgacaaaaggaataccccatttgatatcagagatacacaaaaaaccaattgagggtagtgaatgtaagaagacagtcccagaagtaaaccctcactgtgaatcagagaattcacataggaaagaaaccagatgaagatgaatgcaggaagaattgtgtccaaaatgcaaccttcagagtgtatcaaagaattcagacaggcttctgttttcagagtactatggataggcctgaatgaagtcataccctattagatagctcccacacatcacacaggctggtaatctcttcaccagcaccaatttcattttactccaggcacatagtccagatttcccaatctccttttcatccaggttggtctttgtgactggctactaagatgtggatgtccatgatgtatatcacatcccagtctgaaacataagagacttccctaataaattaccagggccctgtcacaacaaaatggatatcatttctaggacaagcttggtgccgtgctttaatgtggcatggtacaagataaagaagtctgtgcctgaatgaatacacgcagcaaaattctcctcttctgtgtctttcccagttgaacattatgtgagcaaaatttaagcttatacagtagtccccccttatctgtattttcactttacgcaatttccattaaccatggtcaactgtactttaaagttattaaatggatccagaaataaacaattcctacattttaaactgcacccgattctgagtagtgggatgaagtctcatgccctcctgctctcccatgagggttattgaatcattccttagtctagcatatccacagtgtatacactatctgccagttagtcacttacttgacattttagttatcagatcacctgtcagggtatgacagtgcttgtattcaagtaacccttgttttactaaataatggcctgaaattgcaagagcatttctggcatgttgttgtaattattccattattagtccttaatttataaattaggcacagcaagagattaaactatcataggcatgtgtatatgtaggaaaaaaatatagtatatacagggttcagtatacccgtggtttcaaacatcaacttggaattcttggagagcattccttgtagttaagcagggactactgtattctgttgagctttcacatgtttgagtctatttgtttctacacataatttagttatcttctgctaggaaggcagaaagcttctgtgtaagccaggcttaagtcaatcagagggcacaaaccttattaggaggctagagagtcaaggagaacctcaaatatgatcagagaattgtggaaaagacatcctttcaatgtaatgaaattgatagtaccacctgatacagggctttgcatgaacctaaaagtcttttggctgaatggtgagcagccactgtgcagttcaacgtaagtgtgccttaattgcacagaggtactgcccccacacctcctgacacctccatataccccagctatatctgctttaaggagttttccctggctccaaaggccattggcacccacccaagtattatgggaaacctccagagaggggagggactcagatttatatggctttattgaatccatgcccaaggcaacatcttactagttcctgtgggggtacaggacacctagatttagctaatggggtttggcaatgggaaggcaaacaaatttaataactttatgggtgaggtactttgggccagtagagtatactacagttatgtttacatctgaaagtgtagtagggattaattcccataagttatagagagaattctaattccctgtaattcgcataagtcatagaattctaatcaggaataattgtatgtaaagatacctctgaggtccaacagctctgatcattttgggcttcaagtctctctctgtgactggtgattttgtgggttgaaacttctggcaaaagggggcagcccttgggagctgggggccaggggattgacttggttccctgacaagggtaccaggtccaccccttctgaaaagcagctgttagtttactcttgggctcttttacacattggatatctcttccttgggtagagggttctgacctaaaattccactttaggagtttgtcgtcttggactcaacaactaacaaaatgaaaaggacccagcaagcctcacttgtggaatgaaaatggggcattcaggaaagcacctgtcctggccccacagtatgtcagctgtataggcaatagtagtagctgtctcttagaagggaaataatgtatcacctctttccagaacgaagcaaagttgctggcttagtagagccctcaattcatagaggttactgtaattgggcctggctcactgatgctttcgccaactgaaactactaggatcctgtgtgtgttcaaactcagtgccattaacaaacccaaagtgaagcggtcactcctctcagtggaaagagcacgaggatgttctcagctctggccaatactccatttcataaaccatgttacatttttgttaagccttggctctggatgtggcctagatatttgatattctaattggaaattacagattaaaaagcaccctttctttgtacagtgggggtaaaagtcacagctgcttagtacaaccatctgggttgctcaagtagatgcccataataagagactattttctgataagactgactggaatcaagctgccgacagctttctccatccagattgtgacggttgctacctggatccatcattttactggtatggcaaaaaatcacccatgtgacactgggtgacatggtaaaagtacatggtacttttacagtaccatgtactgtacaaaataaaggtctctttatctg

SEQ ID NO: 4127 - DNA, 3335 bp, Homo sapiens
ggccctagcggcttggcggagctggagccctccctggcagtgcgtcggcgctgggctatggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcgaggcttctcagaactttgcttctccagcagaataatcctgcggaagactgagcagttcttgtgagtgtaaaaccatggcccatgcattggtgacgttcagggatgtggctatagacttctctcagaaggaatgggagtgcctggacactacccagaggaaattgtacagagatgtgatgttggagaattataataacttggtctcactgggatattctggctcaaagccagatgtgattaccttactggagcaagggaaagagccctgcgtggtggcgagggatgtgacaggaagacagtgccccggtttgttatccaggcataagaccaagaaattatcttcagaaaaggacattcatgaaatcagtttatccaaagagagtataatagaaaaaagtaaaactcttcgtctgaaaggatccatttttagaaatgagtggcagaacaaaagtgagtttgagggtcaacagggacttaaagaaagatctatcagtcaaaagaaaatcgtctctaaaaaaatgtcaactgatagaaaacgtccctcttttactctgaatcagagaattcacaatagtgagaaaagctgtgactcacacttggttcaacatgggaaaatagattctgatgtgaaacatgattgtaaagaatgtgggagtacttttaataatgtctatcagcttactctccatcagaaaattcatactggtgaaaaatcctgtaaatgtgagaaatgtgggaaagtttttagtcatagctatcaacttactctgcatcagagatttcatactggtgagaaaccctatgaatgtcaagaatgtgggaagacctttactctttacccacaacttaatcgacatcagaaaattcacactggtaaaaaaccctatatgtgtaagaaatgtgataagggtttttttagtagattagaacttactcaacataaaagaattcatactggtaagaaatcttatgaatgtaaagaatgtggaaaagtttttcaacttattttctactttaaagaacatgagagaattcatacaggtaagaaaccctatgaatgtaaggagtgtgggaaagcttttagtgtatgcggacaacttacccgtcatcagaaaattcatactggtgtaaaaccctacgaatgtaaggaatgtggaaagacctttagacttagtttttaccttactgaacacagaagaactcatgcaggtaagaaaccttatgaatgtaaggagtgtgggaaatcatttaatgtgcgtggacagcttaatcggcataaaacaatccatactggtataaaaccttttgcatgtaaggtgtgtgagaaggcttttagttatagtggtgacctcagagtacattctagaattcatactggagagaaaccatatgaatgtaaggaatgcgggaaagcctttatgcttcgttcagtccttactgaacatcagagacttcatactggtgtgaagccctacgaatgtaaggaatgtgggaagacctttcgagttcgttctcaaattagtctacataagaaaattcatactgatgtgaagccctacaaatgtgtacgatgtgggaagacctttagatttggtttctaccttactgaacaccagagaattcacactggtgaaaagccctataaatgtaaagaatgtggaaaggcctttattcgtagagggaatcttaaagaacatctgaaaattcattctggtttaaaaccctatgactgtaaagaatgtgggaagtcctttagtcggcgtgggcagttcactgaacatcagaaaattcatacgggtgtaaaaccatacaaatgtaaagaatgtgggaaggcctttagtcgtagtgtagaccttagaatacatcaaagaattcatactggtgagaaaccctatgagtgtaaacaatgtgggaaggcctttagacttaattcacaccttactgaacatcagagaattcacactggtgagaaaccctatgagtgtaaggtatgtagaaaggcctttagacaatattcacatctttatcaacatcagaaaactcataatgtaatttaatataagaaaaggtttccatgtcatgctctatttatagaatatcaaaatatttatggccagaagttctgtcaatgtgttgatgtttttttacacatattaacttaataaatgtatgagtcttaaatacctcttagttctcattaaatttaggaaaattcacactagaaaataaagctgttaatgtaacagttgtggaaaagtgttctagcaacagcatatacttatcatcattgcctttccactactctactatctgtgtgatattagacaaaatatttgcttcttggtacctcagctgtaaaatgaaacacacctaaaagtgtggttgtttccaacatgtataatacagcaacaactatctggcccaaactgctttggattaatattggatattactgtttttattatcatcaacattattattagtggatttcttaataggaagatgcaatggagatgacaaatttggaaaaaccactcatcacttacatttcatgaagtacttctttgataaaatctgttatgggctgaatgtttgtgttcccgtaacaattcctatgttgaaacacgaatcccaaggtgatggtatttgaaggtagggcctttaggaggaaattaggtcatgagggtggagccttcatgagtggaattactgcctttataagaagaagccaaagagccagctagctctttcaaccacatgaggttacagcaagaagtcagcagtctacagtgcaaaagagggccttcaccagaacccaagcatgctggcaccttgaccttggactttcagcctccaaaactgtgagaaataaacctcagttgtttataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4128 - DNA, 5541 bp, Homo sapiens
cagtgccgtttaacctttattgtggtggagtccaccccgctgtgggcctcagataaccctgtacaaaagggaatggagattgcctgtatccacctagattcataagctgccctgaggcgatcttggcatcaagaaagacagcattgaggcacatctcaccatcagcttcagaggatgtcagcctttgatatgtcccatgatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaacttaatccatgtggaaaagtcttcaccttaactccaggccttgctgtgcatcttgaaattctcaatggaagacaaccctacgaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggagagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaatacaacatcatggttacctgagtctgggcatctgtgaagaagggtcatggatggtgaggtcagtactgcaggctgcctcaccttggtgattagattcctaagatcatagcattaacaagttctgtacgagataaatcatgcagattgatcccagcccctgttggttagtggctgccagtgtggcacattcatgtcaaaatttaccagaagccaagatgatgtaggccccagaggtggattgttaaaaagatgctcctccaaggttctcttctgttcccatggatcctgcagagcatgtcaggagtgaaaccatccataactgccagtgccctttcacagctgattatttctatgtccccttcttgtaaaataagaagtgtgacaaccttgactgttctgttctgtcttctctgtccattttaggtggcacaatgtaagtggcagtgtctcttatagtataatccagtctctcttctcacttctgttaagatggctgatatagtccatgaatcccactcatgatctctttatcaaatgattgttcagccacactttgaggattctcttcagtacaagttttctaatttttgcagtatggataggctgagaattttccaaatctccaagttctggttcctttttccttaacaacttcttctgcaattcaggtctccttttgcatttttgccgagaccagctgggtcgtggagaccctaacccagtggctctagaggaattaagacaaagacacagaaatatagtgcagagtgggaatcggggctcacagccttcagagctgagcttgaacagagtttgtcccacatatttattgacagtaagcctgtgataaacattattcctatagattgtagatcagctataagtattccttatgagaaagaaagggacaggctctggcttgttatctgcaacaggaatatgtccttaaggcacaaatcactcatgctattgtttgtggtttaggaatgccttgagcagttttccagttttctgccctgggtgggccaggtgttgcttgccctcattctggtaaaccagcagcctccagcatgggcgtcatagccatcacgagcatgtcacagtgctgcagagattttgtttatggccagtttctcattgcctgtttatggccagatttggggggcctgttcccagcacattttcctgtaagcactcaggaataatgaagcttcctgtgtcctttaacactttaattacagatcttagtgatacataccattttatctgtctcaagctctaccttccgtaaaatgctagaatacagttctgccaagttcttcaccactttatatcaagggttgtcttttcttcatttcccaatagcatgttcctcattccccaatgacacctcaccagaataacccttaccaaccttatttccagcttgcacatcagaatttttccagcctctactcatttgtcagtttcaaagctgcttcacatttttagtttttttgtttgtttttaattgcagtacctcacttctcagtaccaatatctgccttagtcagctcagacaaccataagagaataccgcagaccaaatggcttagaaattaatttaattttaaatcaatgaggttaaaaacacaggatttttttttttttttttttttttttttgaaatggagttttgctcttgttgcccaggctggagtgcaatggtatgatcttggctcaccgcaacctccacctcctgagttccagtgattctcctgcctcaccctcagtagctgggattattggcatgcaccacaaaccttagctaagtttgtatttttagtagagacagggtttctccatgttggttaggctgatctccatgttggtcagatctgacctttggtgatccacctgccttggcctcccaaagtgctgggattacaggcctgagccaccgtatctggcccaaaacacaaatttatattctcacatatctggaggctggaagtctgagatcagagtgccagcatggtcaacctctagtgagagctctcttcctggcatgtaagtgcccacttcctcatgttttcacacgatggagaccaacaaataggtcggtcggtctcccccctccccgcccccttctcttttcacatacagtcacattgaggtttggaacttcatatgaaatttggggggtcactgtgtgtgtgtgtgtgtgtgtgtgtatgtgtatatatatatacatatatatacacatatgtatgtatacctaactcctaaagtggaacagtaagagtcattatttatagattatctgattctctatgtggaaagagaaaagaatcatattaagtactttggactgaacaatggcccccaaaattcgtatgacgatgaagctctctctaaatattttcttgctttactggactgattttaacccgctgcacaacaccaactaaaagtagtaataccagcatacttgtctttgcagttctggtgagatatgcactctattttgttggtttggctgtaggcttttatttcttttttattttttgaagaggttatgtcctgtcagggaaccagccccgatattcacataggttcttttctattttccctaagtgtcagccaacttgagaaataaagggacagagtacaaaagagagaaattttaaagctgggtgtccggggcagacatcacatgtcggtaggttccgtgatgccccacaagccgcaaaaaccagcaagtttttattagggattttcaaaaggggagggagtgtgcaaataggtgtgggtcacagacatcaagtactttacaaggtaatagaatatcacaaggcaagtggaggcagggcgagatcacaggaccaaggtgaaattaaaattgctaatgaagttttgggcaccattgtcattgataacatcttatcaggagacggttttgagatcaactggtctgactaaaatttattaggtgggaatttcctcttcctaataagcctgggagtgctatgggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaggacaggcataagaaattataaaagtattaatttggggaactaataaatgtccatgaaacctccacaatccatgtttttctgccatggcttcagccagtccccccgtttggggtccctgacttcctgcaacaatgtcctgcaggaaaagttttttctttatatccagtttttacatgatgaattatttcccaatatttcatagtttatgaggctgaattcctcttgaatttattaaatgcttccttcacatcctctgtgatgatcatgtttatttactgataaaactcaatacctagaactgcacctagctcatgatggtacctaataaatacttcaatgaaatgatgtggtgatgcatgcctatagttttagctacttgggagggtggcctgagcccaggggttctagaccagcttaggcaacatagcaagaccccatctcaaaaaaaaaagcatcagcaaaaacaaaaaaaaaaaaaaaaa

SEQ ID NO: 4129 - protein, 1642 aa, Homo sapiens
MSTAIREVGVWRQTRTLLLKNYLIKCRTKKSSVQEILFPLFFLFWLILISMMHPNKKYEEVPNIELNPMDKFTLSNLILGYTPVTNITSSIMQKVSTDHLPDVIITEEYTNEKEMLTSSLSKPSNFVGVVFKDSMSYELRFFPDMIPVSSIYMDSRAGCSKSCEAAQYWSSGFTVLQASIDAAIIQLKTNVSLWKELESTKAVIMGETAVVEIDTFPRGVILIYLVIAFSPFGYFLAIHIVAEKEKKIKEFLKIMGLHDTAFWLSWVLLYTSLIFLMSLLMAVIATASLLFPQSSSIVIFLLFFLYGLSSVFFALMLTPLFKKSKHVGIVEFFVTVAFGFIGLMIILIESFPKSLVWLFSPFCHCTFVIGIAQVMHLEDFNEGASFSNLTAGPYPLIITIIMLTLNSIFYVLLAVYLDQVIPGEFGLRRSSLYFLKPSYWSKSKRNYEELSEGNVNGNISFSEIIEPVSSEFVGKEAIRISGIQKTYRKKGENVEALRNLSFDIYEGQITALLGHSGTGKSTLMNILCGLCPPSDGFASIYGHRVSEIDEMFEARKMIGICPQLDIHFDVLTVEENLSILASIKGIPANNIIQEVQKVLLDLDMQTIKDNQAKKLSGGQKRKLSLGIAVLGNPKILLLDEPTAGMDPCSRHIVWNLLKYRKANRVTVFSTHFMDEADILADRKAVISQGMLKCVGSSMFLKSKWGIGYRLSMYIDKYCATESLSSLVKQHIPGATLLQQNDQQLVYSLPFKDMDKFSGLFSALDSHSNLGVISYGVSMTTLEDVFLKLEVEAEIDQADYSVFTQQPLEEEMDSKSFDEMEQSLLILSETKAALVSTMSLWKQQMYTIAKFHFFTLKRESKSVRSVLLLLLIFFTVQIFMFLVHHSFKNAVVPIKLVPDLYFLKPGDKPHKYKTSLLLQNSADSDISDLISFFTSQNIMVTMINDSDYVSVAPHSAALNVMHSEKDYVFAAVFNSTMVYSLPILVNIISNYYLYHLNVTETIQIWSTPFFQEITDIVFKIELYFQAALLGIIVTAMPPYFAMENAENHKIKAYTQLKLSGLLPSAYWIGQAVVDIPLFFIILILMLGSLLAFHYGLYFYTVKFLAVVFCLIGYVPSVILFTYIASFTFKKILNTKEFWSFIYSVAALACIAITEITFFMGYTIATILHYAFCIIIPIYPLLGCLISFIKISWKNVRKNVDTYNPWDRLSVAVISPYLQCVLWIFLLQYYEKKYGGRSIRKDPFFRNLSTKSKNRKLPEPPDNEDEDEDVKAERLKVKELMGCQCCEEKPSIMVSNLHKEYDDKKDFLLSRKVKKVATKYISFCVKKGEILGLLGPNGAGKSTIINILVGDIEPTSGQVFLGDYSSETSEDDDSLKCMGYCPQINPLWPDTTLQEHFEIYGAVKGMSASDMKEVISRITHALDLKEHLQKTVKKLPAGIKRKLCFALSMLGNPQITLLDEPSTGMDPKAKQHMWRAIRTAFKNRKRAAILTTHYMEEAEAVCDRVAIMVSGQLRCIGTVQHLKSKFGKGYFLEIKLKDWIENLEVDRLQREIQYIFPNASRQESFSSILAYKIPKEDVQSLSQSFFKLEEAKHAFAIEEYSFSQATLEQVFVELTKEQEEEDNSCGTLNSTLWWERTQEDRVVF

SEQ ID NO: 4130 - protein, 1642 aa, Homo sapiens; identical to SEQ ID NO: 4129

SEQ ID NO: 4131 - protein, 718 aa, Homo sapiens
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 4132 - protein, 746 aa, Homo sapiens
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRLPNIRRSSSDFFYSKSLIRRTGRSPSLQPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 4133 - protein, 778 aa, Homo sapiens
MPAFLGLKCLGKLCSSEKSKVTSSERTSARGSNRKRLIVEDRRVSGTSFTAHRRATITHLLYLCPKDYCPRGRVCNSVDPFVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 4134 - protein, 455 aa, Homo sapiens
MFTEGEEMYLQGSTVWHPDCKQSTKTEEKLRLPNIRRSSSDFFYSKSLIRRTGRSPSLQPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 4135 - protein, 418 aa, Homo sapiens
MAGRLPACVVDCGTGYTKLGYAGNTEPQFIIPSCIAIKESAKVGDQAQRRVMKGVDDLDFFIGDEAIEKPTYATKWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTPEFYQVCHTKKDYEEIGPSICRHNPVFGVMS

SEQ ID NO: 4136 - protein, 956 aa, Homo sapiens
MPGGAGAARLCLLAFALQPLRPRAAREPGWTSKGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKVSPREALKVKAGTRGLQGGRCRVEKTKQFMLLVVWTELPEQKPRAKHSCFLVPA

SEQ ID NO: 4137 - protein, 918 aa, Homo sapiens
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKFPEYRSQRAGGMISSKI

SEQ ID NO: 4138 - protein, 232 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATS

SEQ ID NO: 4139 - protein, 3907 aa, Homo sapiens
MEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSEPWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 4140 - protein, 1655 aa, Homo sapiens
MEDEERQKKLEAGKAKIEELSLAFLVRQLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQVRVL

SEQ ID NO: 4141 - protein, 3911 aa, Homo sapiens
MEDEERQKKLEAGKAKIEELSLAFLVRQLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEVFGFYNMCFSTLCDSGSDWGQGIYLTHSQGFDIASEGRGEESESATDSFPKKIKGLLRAVHNEGMQVLSLTESPYSDGEDHSIQQVSEPWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 4142 - protein, 3899 aa, Homo sapiens
MEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSEPWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 4143 - protein, 494 aa, Homo sapiens
MSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 4144 - protein, 488 aa, Homo sapiens
MAGKGSSGRRPLLLGLLVAVATVHLVICPYTKVEESFNLQATHDLLYHWQDLEQYDHLEFPGVVPRTFLGPVVIAVFSSPAVYVLSLLEMSKFYSQLIVRGVLGLGVIFGLWTLQKEVRRHFGAMVATMFCWVTAMQFHLMFYCTRTLPNVLALPVVLLALAAWLRHEWARFIWLSAFAIIVFRVELCLFLGLLLLLALGNRKVSVVRALRHAVPAGILCLGLTVAVDSYFWRQLTWPEGKVLWYNTVLNKSSNWGTSPLLWYFYSALPRGLGCSLLFIPLGLVDRRTHAPTVLALGFMALYSLLPHKELRFIIYAFPMLNITAARGCSYLLNNYKKSWLYKAGSLLVIGHLVVNAAYSATALYVSHFNYPGGVAMQRLHQLVPPQTDVLLHIDVAAAQTGVSRFLQVNSAWRYDKREDVQPGTGMLAYTHILMEAAPGLLALYRDTHRVLASVVGTTGVSLNLTQLPPFNVHLQTKLVLLERLPRPS

SEQ ID NO: 4145 - protein, 755 aa, Homo sapiens
MASVHESLYFNPMMTNGVVHANVFGIKDWVTPYKIAVLVLLNEMSRTGEGAVSLMERRRLNQLLLPLLQGPDITLSKLYKLIEESCPQLANSVQIRIKLMAEGELKDMEQFFDDLSDSFSGTEPEVHKTSVVGLFLRHMILAYSKLSFSQVFKLYTALQQYFQNGEKKTVEDADMELTSRDEGERKMEKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 4146 - protein, 1124 aa, Homo sapiens
MDPFTEKLLERTRARRENLQRKMAERPTAAPRSMTHAKRARQPLSEASNQQPLSGGEEKSCTKPSPSKKRCSDNTEVEVSNLENKQPVESTSAKSCSPSPVSPQVQPQAADTISDSVAVPASLLGMRRGLNSRLEATAASSVKTRMQKLAEQRRRWDNDDMTDDIPESSLFSPMPSEEKAASPPRPLLSNASATPVGRRGRLANLAATICSWEDDVNHSFAKQNSVQEQPGTACLSKFSSASGASARINSSSVKQEATFCSQRDGDASLNKALSSSADDASLVNASISSSVKATSPVKSTTSITDAKSCEGQNPELLPKTPISPLKTGVSKPIVKSTLSQTVPSKGELSREICLQSQSKDKSTTPGGTGIKPFLERFGERCQEHSKESPARSTPHRTPIITPNTKAIQERLFKQDTSSSTTHLAQQLKQERQKELACLRGRFDKGNIWSAEKGGNSKSKQLETKQETHCQSTPLKKHQGVSKTQSLPVTEKVTENQIPAKNSSTEPKGFTECEMTKSSPLKITLFLEEDKSLKVTSDPKVEQKIEVIREIEMSVDDDDINSSKVINDLFSDVLEEGELDMEKSQEEMDQALAESSEEQEDALNISSMSLLAPLAQTVGVVSPESLVSTPRLELKDTSRSDESPKPGKFQRTRVPRAESGDSLGSEDRDLLYSIDAYRSQRFKETERPSIKQVIVRKEDVTSKLDEKNNAFPCQVNIKQKMQELNNEINMQQTVIYQASQALNCCVDEEHGKGSLEEAEAERLLLIATGKRTLLIDELNKLKNEGPQRKNKASPQSEFMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRETLVSQCRDTLCVTKNWLSADTKEERDLWMQKLNQVLVDIRLWQPDACYKPIGKP

SEQ ID NO: 4147 - protein, 4563 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYNNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPETDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVVENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELTHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMQNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPHFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVAKTTKAEIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFITPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTLAHRDFSAEYEEDGKFEGLQEWEGKAHLNIKSPAFTDLHLRYQKDKKGISTSAASPAVGTVGMDMDEDDDFSKWNFYYSPQSSPDKKLTIFKTELRVRESDEETQIKVNWEEEAASGLLTSLKDNVPKATGVLYDYVNKYHWEHTGLTLREVSSKLRRNLQNNAEWVYQGAIRQIDDIDVRFQKAASGTTGTYQEWKDKAQNLYQELLTQEGQASFQGLKDNVFDGLVRVTQKFHMKVKHLIDSLIDFLNFPRFQFPGKPGIYTREELCTMFIREVGTVLSQVYSKVHNGSEILFSYFQDLVITLPFELRKHKLIDVISMYRELLKDLSKEAQEVFKAIQSLKTTEVLRNLQDLLQFIFQLIEDNIKQLKEMKFTYLINYIQDEINTIFNDYIPYVFKLLKENLCLNLHKFNEFIQNELQEASQELQQIHQYIMALREEYFDPSIVGWTVKYYELEEKIVSLIKNLLVALKDFHSEYIVSASNFTSQLSSQVEQFLHRNIQEYLSILTDPDGKGKEKIAELSATAQEIIKSQAIATKKIISDYHQQFRYKLQDFSDQLSDYYEKFIAESKRLIDLSIQNYHTFLIYITELLKKLQSTTVMNPYMKLAPGELTIIL

SEQ ID NO: 4148 - protein, 475 aa, Homo sapiens
MQKSTNSDTSVETLNSTRQGTGAVQMRIKNANSHHDRLSQSKSMILTDVGKVTEPISRHRRNHSQHILKDVIPPLEQLMVEKEGYLQKAKIADGGKKLRKNWSTSWIVLSSRRIEFYKESKQQALSNMKTGHKPESVDLCGAHIEWAKEKSSRKNVFQITTVSGNEFLLQSDIDFIILDWFHAIKNAIDRLPKDSSCPSRNLELFKIQRSSSTELLSHYDSDIKEQKPEHRKSLMFRLHHSASDTSDKNRVKSRLKKFITRRPSLKTLQEKGLIKDQIFGSHLHKVCERENSTVPWFVKQCIEAVEKRGLDVDAIYRVSGNLQTIQKLRFIVNQEEKLNLDDSQWEDIHVVTGALKMFFRELPEPLFPYSFFEQFVEAIKKQDNNTRIEAVKSLVQKLPPPNRDTMKVLFGHLTKIVAKASKNLMSTQSLGIVFGPTLLRAENETGNMAIHMVYQNQIAELMLSEYSKIFGSEED

SEQ ID NO: 4149 - protein, 464 aa, Homo sapiens
MAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKDGDLTMWPRLVSNSKLKRSSHLSLPKYWDYRYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 4150 - protein, 433 aa, Homo sapiens
MAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 4151 - protein, 2285 aa, Homo sapiens
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQNYKRPMDGTYGPPAKRHEGEMYSVPYSTGQGQPQQQQLPPAQPQPASQQQAAQPSPQQDVYNQYGNAYPATATAATERRPAGGPQNQFPFQFGRDRVSAPPGTNAQQNMPPQMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 4152 - protein, 1374 aa, Homo sapiens
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQEPRRHGG

SEQ ID NO: 4153 - protein, 2068 aa, Homo sapiens
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 4154 - protein, 112 aa, Homo sapiens
MSAEVPEAASAEEQKEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 4155 - protein, 89 aa, Homo sapiens
MSEQGDLNQAIAEEGGTEQETATPENGIVKSESLDEEEKLELQRRLEAQNQERRKSKSGAGKGKLTRSLAVCEESSARPGGESLQDQTL

SEQ ID NO: 4156 - protein, 89 aa, Homo sapiens; identical to SEQ ID NO: 4155

SEQ ID NO: 4157 - protein, 89 aa, Homo sapiens; identical to SEQ ID NO: 4155

SEQ ID NO: 4158 - protein, 2202 aa, Homo sapiens
MALPRLTGALRSFSNVTKQDNYNEEVADLKIKRSKLHEQVLDLGLTWKKIIKFLNEKLEKSKMQSINEDLKDILHAAKQIVGTDNGREAIESGAAFLFMTFHLKDSVGHKETKAIKQMFGPFPSSSATAACNATNRIISHFSQDDLTALVQMTEKEHGDRVFFGKNLAFSFDMHDLDHFDELPINGETQKTISLDYKKFLNEHLQEACTPELKPVEKTNGSFLWCEVEKYLNSTLKEMTEVPRVEDLCCTLYDMLASIKSGDELQDELFELLGPEGLELIEKLLQNRITIVDRFLNSSNDHRFQALQDNCKKILGENAKPNYGCQVTIQSEQEKQLMKQYRREEKRIARREKKAGEDLEVSEGLMCFDPKELRIQREQALLNARSVPILSRQRDADVEKIHYPHVYDSQAEAMKTSAFIAGAKMILPEGIQRENNKLYEEVRIPYSEPMPLSFEEKPVYIQDLDEIGQLAFKGMKRLNRIQSIVFETAYNTNENMLICAPTGAGKTNIAMLTVLHEIRQHFQQGVIKKNEFKIVYVAPMKALAAEMTDYFSRRLEPLGIIVKELTGDMQLSKSEILRTQMLVTTPEKWDVVTRKSVGDVALSQIVRLLILDEVHLLHEDRGPVLESIVARTLRQVESTQSMIRILGLSATLPNYLDVATFLHVNPYIGLFFFDGRFRPVPLGQTFLGIKCANKMQQLNNMDEVCYENVLKQVKAGHQVMVFVHARNATVRTAMSLIERAKNCGHIPFFFPTQGHDYVLAEKQVQRSRNKQVRELFPDGFSIHHAGMLRQDRNLVENLFSNGHIKVLVCTATLAWGVNLPAHAVIIKGTQIYAAKRGSFVDLGILDVMQIFGRAGRPQFDKFGEGIIITTHDKLSHYLTLLTQRNPIESQFLESLADNLNAEIALGTVTNVEEAVKWISYTYLYVRMRANPLAYGISHKAYQIDPTLRKHREQLVIEVGRKLDKAQMIRFEERTGYFSSTDLGRTASHYYIKYNTIETFNELFDAHKTEGDIFAIVSKAEEFDQIKVREEEIEELDTLLSNFCELSTPGGVENSYGKINILLQTYISRGEMDSFSLISDSAYVAQNAARIVRALFEIALRKRWPTMTYRLLNLSKVIDKRLWGWASPLRQFSILPPHILTRLEEKKLTVDKLKDMRKDEIGHILHHVNIGLKVKQCVHQIPSVMMEASIQPITRTVLRVTLSIYADFTWNDQVHGTVGEPWWIWVEDPTNDHIYHSEYFLALKKQVISKEAQLLVFTIPIFEPLPSQYYIRAVSDRWLGAEAVCIINFQHLILPERHPPHTELLDLQPLPITALGCKAYEALYNFSHFNPVQTQIFHTLYHTDCNVLLGAPTGSGKTVAAELAIFRVFNKYPTSKAVYIAPLKALVRERMDDWKVRIEEKLGKKVIELTGDVTPDMKSIAKADLIVTTPEKWDGVSRSWQNRNYVQQVTILIIDEIHLLGEERGPVLEVIVSRTNFISSHTEKPVRIVGLSTALANARDLADWLNIKQMGLFNFRPSVRPVPLEVHIQGFPGQHYCPRMASMNKPAFQAIRSHSPAKPVLIFVSSRRQTRLTALELIAFLATEEDPKQWLNMDEREMENIIATVRDSNLKLTLAFGIGMHHAGLHERDRKTVEELFVNCKVQVLIATSTLAWGVNFPAHLVIIKGTEYYDGKTRRYVDFPITDVLQMMGRAGRPQFDDQGKAVILVHDIKKDFYKKFLYEPFPVESSLLGVLSDHLNAEIAGGTITSKQDALDYITWTYFFRRLIMNPSYYNLGDVSHDSVNKFLSHLIEKSLIELELSYCIEIGEDNRSIEPLTYGRIASYYYLKHQTVKMFKDRLKPECSTEELLSILSDAEEYTDLPVRHNEDHMNSELAKCLPIESNPHSFDSPHTKAHLLLQAHLSRAMLPCPDYDTDTKTVLDQALRVCQAMLDVAANQGWLVTVLNITNLIQMVIQGRWLKDSSLLTLPNIENHHLHLFKKWKPIMKGPHARGRTSIESLPELIHACGGKDHVFSSMVESELHAAKTKQAWNFLSHLPVINVGISVKGSWDDLVEGHNELSVSTLTADKRDDNKWIKLHADQEYVLQVSLQRVHFGFHKGKPESCAVTPRFPKSKDEGWFLILGEVDKRELIALKRVGYIRNHHVASLSFYTPEIPGRYIYTLYFMSDCYLGLDQQYDIYLNVTQASLSAQVNTKVSDSLTDLALK

SEQ ID NO: 4159 - protein, 111 aa, Homo sapiens
MALPRLTGALRSFSNVTKQDNYNEEVADLKIKRSKLHEQVLDLGLTWKKIIKFLNEKLEKSKMQSINEDLKDILHAAKQIEVNCPFQKRRLDGKEEDEKMSRASDRFRGLR

SEQ ID NO: 4160 - protein, 561 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 4161 - protein, 561 aa, Homo sapiens; identical to SEQ ID NO: 4160

SEQ ID NO: 4162 - protein, 561 aa, Homo sapiens; identical to SEQ ID NO: 4160

SEQ ID NO: 4163 - protein, 758 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 4164 - protein, 225 aa, Homo sapiens
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLEGPSGVAKRKTKAKVKELTKEELKKEKEKPESRKESKNEERKKGKKEDVRKDKKIADADLSRKESPKGKKDREKEKVDLEKSAKTKENRKKSTNMKDVSSKMASRDKDDRKESRSSTRYAHLTKGNTQKRNG

SEQ ID NO: 4165 - protein, 313 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 4166 - protein, 210 aa, Homo sapiens
MAEDKETKHGGHKNGRKGGLSGTSFFTWFMVIALLGVWTSVAVVWFDLVDYEEVLGKLGIYDADGDGDFDVDDAKVLLEGPSGVAKRKTKAKVKELTKEELKKEKEKPESRKESKNEERKKGKKEDVRKDKKIADADLSRKESPKGKKDREKEKVDLEKSAKTKENRKKSTNMKDVSSKMASRDKDDRKESRSSTRYAHLTKGNTQKRNG

SEQ ID NO: 4167 - protein, 299 aa, Homo sapiens
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 4168 - protein, 1020 aa, Homo sapiens
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 4169 - protein, 1176 aa, Homo sapiens
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEQERIDKIWPKLRVLARSSPTDKHTLVKGIIDSTVSDQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGEKFFDIDSGRNAPLHAPPSEHYTIVFNTFVLMQLFNEINARKIHGERNVFEGIFNNAIFCTIVLGTFVVQIIIVQFGGKPFSCSELSIEQWLWSIFLGMGTLLWGQLISTIPTSRLKFLKEAGHGTQKEEIPEEELAEDVEEIDHAERELRRGQILWFRGLNRIQTQMDVVNAFQSGSSIQGALRRQPSIASQHHDVTNISTPTHVVFSSSTASTTVGYSSGECIS

SEQ ID NO: 4170 - protein, 1220 aa, Homo sapiens
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEQERIDKIWPKLRVLARSSPTDKHTLVKGIIDSTVSDQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGEKFFDIDSGRNAPLHAPPSEHYTIVFNTFVLMQLFNEINARKIHGERNVFEGIFNNAIFCTIVLGTFVVQIIIVQFGGKPFSCSELSIEQWLWSIFLGMGTLLWGQLISTIPTSRLKFLKEAGHGTQKEEIPEEELAEDVEEIDHAERELRRGQILWFRGLNRIQTQIRVVNAFRSSLYEGLEKPESRSSIHNFMTHPEFRIEDSEPHIPLIDDTDAEDDAPTKRNSSPPPSPNKNNNAVDSGIHLTIEMNKSATSSSPGSPLHSLETSL

SEQ ID NO: 4171 - protein, 553 aa, Homo sapiens
MLSVRVAAAVVRALPRRAGLVSRNALGSSFIAARNFHASNTHLQKTGTAEMSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 4172 - protein, 553 aa, Homo sapiens; identical to SEQ ID NO: 4171

SEQ ID NO: 4173 - protein, 247 aa, Homo sapiens
MSGKDRIEIFPSRMAQTIMKARLKGAQTGRNLLKKKSDALTLRFRQILKKIIETKMLMGEVMREAAFSLAEAKFTAGDFSTTVIQNVNKAQVKIRAKKDNVAGVTLPVFEHYHEGTDSYELTGLARGGEQLAKLKRNYAKAVELLVELASLQTSFVTLDEAIKITNRRVNAIEHVIIPRIERTLAYIITELDEREREEFYRLKKIQEKKKILKEKSEKDLEQRRAAGEVLEPANLLAEEKDEDLLFE

SEQ ID NO: 4174 - protein, 1379 aa, Homo sapiens
METGGRARTGTPQPAAPGVWRARPAGGGGGGASSWLLDGNSWLLCYGFLYLALYAQVSQSKPCERTGSCFSGRCVNSTCLCDPGWVGDQCQHCQGRFKLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGPDCSLNVPSTESYWILPNVKPFSPSVGRASHKAVLHGKFMWVIGGYTFNYSSFQMVLNYNLESSIWNVGTPSRGPLQRYGHSLALYQENIFMYGGRIETNDGNVTDELWVFNIHSQSWSTKTPTVLGHGQQYAVEGHSAHIMELDSRDVVMIIIFGYSAIYGYTSSIQEYHISSNTWLVPETKGAIVQGGYGHTSVYDEITKSIYVHGGYKALPGNKYGLVDDLYKYEVNTKTWTILKESGFARYLHSAVLINGAMLIFGGNTHNDTSLSNGAKCFSADFLAYDIACDEWKILPKPNLHRDVNRFGHSAVVINGSMYIFGGFSSVLLNDILVYKPPNCKAFRDEELCKNAGPGIKCVWNKNHCESWESGNTNNILRAKCPPKTAASDDRCYRYADCASCTANTNGCQWCDDKKCISANSNCSMSVKNYTKCHVRNEQICNKLTSCKSCSLNLNCQWDQRQQECQALPAHLCGEGWSHIGDACLRVNSSRENYDNAKLYCYNLSGNLASLTTSKEVEFVLDEIQKYTQQKVSPWVGLRKINISYWGWEDMSPFTNTTLQWLPGEPNDSGFCAYLERAAVAGLKANPCTSMANGLVCEKPVVSPNQNARPCKKPCSLRTSCSNCTSNGMECMWCSSTKRCVDSNAYIISFPYGQCLEWQTATCSPQNCSGLRTCGQCLEQPGCGWCNDPSNTGRGHCIEGSSRGPMKLIGMHHSEMVLDTNLCPKEKNYEWSFIQCPACQCNGHSTCINNNVCEQCKNLTTGKQCQDCMPGYYGDPTNGGQCTACTCSGHANICHLHTGKCFCTTKGIKGDQCQLCDSENRYVGNPLRGTCYYSLLIDYQFTFSLLQEDDRHHTAINFIANPEQSNKNLDISINASNNFNLNITWSVGSTAGTISGEETSIVSKNNIKEYRDSFSYEKFNFRSNPNITFYVYVSNFSWPIKIQIAFSQHNTIMDLVQFFVTFFSCFLSLLLVAAVVWKIKQTCWASRRREQLLRERQQMASRPFASVDVALEVGAEQTEFLRGPLEGAPKPIAIEPCAGNRAAVLTVFLCLPRGSSGAPPPGQSGLAIASALIDISQQKASDSKDKTSGVRNRKHLSTRQGTCV

SEQ ID NO: 4175 - protein, 168 aa, Homo sapiens
MFQIPEFEPSEQEDSSSAERGLGPSPAGDGPSGSGKHHRQAPGLLWDASHQQEQPTSSSHHGGAGAVEIRSRHSSYPAGTEDDEGMGEEPSPFRGRSRSAPPNLWAAQRYGRELRRMSDEFVDSFKKGLPRPKSAGTATQMRQSSSWTRVFQSWWDRNLGRGSSAPSQ

SEQ ID NO: 4176 - protein, 168 aa, Homo sapiens; identical to SEQ ID NO: 4175

SEQ ID NO: 4177 - protein, 920 aa, Homo sapiens
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 4178 - protein, 1802 aa, Homo sapiens
MAAAPTQIEAELYYLIARFLQSGPCNKSAQVLVQELEEHQLIPRRLDWEGKEHRRSFEDLVAANAHIPPDYLLKICERIGPLLDKEIPQSVPGVQTLLGVGRQSLLRDAKDCKSTLWNGSAFAALHRGRPPELPVNYVKPPNVVNITSARQLTGCSRFGHIFPSSAYQHIKMHKRILGHLSSVYCVAFDRSGRRIFTGSDDCLVKIWATDDGRLLATLRGHSAEISDMAVNYENTLIAAGSCDKVVRVWCLRTCAPVAVLQGHSASITSIQFCPSTKGTNRYLTSTGADGTICFWQWHVKTMKFRDRPVKFTERSRPGVQISCSSFSSGGMFITTGSTDHVIRIYYLGSEVPEKIAELESHTDKVVAVQFCNNGDSLRFVSGSRDGTARIWQYQQQEWKSIVLDMATKMTGNNLPSGEDKITKLKVTMVAWDRYDTTVITAVNNFLLKVWNSITGQLLHTLSGHDDEVFVLEAHPFDQRIILSAGHDGNIFIWDLDRGTKIRNYFNMIEGQGHGAVFDCKFSPDGNHFACTDSHGHLLLFGFGCSKYYEKIPDQMFFHTDYRPLIRDANNYVLDEQTQQAPHLMPPPFLVDVDGNPHPTKFQRLVPGRENCKDEQLIPQLGYVANGDGEVVEQVIGQQTNDQDESILDGIIRELQREQDLRLINEGDVPHLPVNRAYSVNGALRSPNMDISSSPNIRLRRHSSQIEGVRQMHNNAPRSQMATERDLMAWSRRVVVNELNNGVSRVQEECRTAKGDIEISLYTVEKKKKPSYTTQRNDYEPSCGRSLRRTQRKRQHTYQTRSNIEHNSQASCQNSGVQEDSDSSSEEDETVGTSDASVEDPVVEWQSESSSSDSSSEYSDWTADAGINLQPPKRQTRQTTRKICSSSDEENLKSLEERQKKPKQTRKKKGGLVSIAGEPNEEWFAPQWILDTIPRRSPFVPQMGDELIYFRQGHEAYVRAVRKSKIYSVNLQKQPWNKMDLREQEFVKIVGIKYEVGPPTLCCLKLAFLDPISGKMTGESFSIKYHDMPDVIDFLVLHQFYNEAKERNWQIGDRFRSIIDDAWWFGTVESQQPFQPEYPDSSFQCYSVHWDNNEREKMSPWDMEPIPEGTAFPDEVGAGVPVSQEELTALLYKPQEGEWGAHSRDEECERVIQGINHLLSLDFASPFAVPVDLSAYPLYCTVVAYPTDLNTIRRRLENRFYRRISALMWEVRYIEHNARTFNEPDSPIVKAAKIVTDVLLRFIGDQSCTDILDTYNKIKAEERNSTDAEEDTEIVDLDSDGPGTSSGRRVKCRGRRQSLKCNPDAWKKQCKELLSLIYEREDSEPFRQPADLLSYPGHQEQEGESSESVVPERQQDSSLSEDYQDVIDTPVDFSTVKETLEAGNYGSPLEFYKDVRQIFNNSKAYTSNKKSRIYSMMLRLSALFESHIKNIISEYKSAIQSQKRRRPRYRKRLRSSSSSLSSSGAPSPKGKQKQMKLQPKNDQNTSVSHARTSSPFSSPVSDAAEGLSLYLLDDEPDGPFSSSSFGGYSRSGNSHDPGKAKSFRNRVLPVKQDHSLDGPLTNGDGREPRTGIKRKLLSASEEDENMGGEDKEKKETKEKSHLSTSESGELGSSLSSESTCGSDSDSESTSRTDQDYVDGDHDYSKFIQTRPKRKLRKQHGNGKRNWKTRGTGGRGRWGRWGRWSRGGRGRGGRGRGSRGRGGGGTRGRGRGRGGRGASRGATRAKRARIADDEFDTMFSGRFSRLPRIKTRNQGRRTVLYNDDSDNDNFVSTEDPLNLGTSRSGRVRKMTEKARVSHLMGWNY

SEQ ID NO: 4179 - protein, 206 aa, Homo sapiens
MRRTGAPAQADSRGRGRARGGCPGGEATLSQPPPRGGTRGQEPQMKETIMNQEKLAKLQAQVRIGGKGTARRKKKVVHRTATADDKKLQFSLKKLGVNNISGIEEVNMFTNQGTVIHFNNPKVQASLAANTFTITGHAETKQLTEMLPSILNQLGADSLTSLRRLAEALPKQSVDGKAPLATGEDDDDEVPDLVENFDEASKNEAN

SEQ ID NO: 4180 - protein, 162 aa, Homo sapiens
MKETIMNQEKLAKLQAQVRIGGKGTARRKKKVVHRTATADDKKLQFSLKKLGVNNISGIEEVNMFTNQGTVIHFNNPKVQASLAANTFTITGHAETKQLTEMLPSILNQLGADSLTSLRRLAEALPKQSVDGKAPLATGEDDDDEVPDLVENFDEASKNEAN

SEQ ID NO: 4181 - protein, 419 aa, Homo sapiens
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKEVVLYVKEEMKRNDLPETAVIGLLWTCIMNAVEWNKKEELVAEQALKHLKQYAPLLAVFSSQGQSELILLQKVQEYCYDNIHFMKAFQKIVVLFYKADVLSEEAILKWYKEAHVAKGKSVFLDQMKKFVEWLQNAEEESESEGEEN

SEQ ID NO: 4182 - protein, 719 aa, Homo sapiens
MMQGNKKCTDAFSDSSSIGSVLDDADREVSSLTDRAFRSLCISEDTSFHDSYLAVSPDITRQVFGTFHQRTVGHTQRKSGIWSQLPSQGTEHSGWAATFQQLPKYVQGEEKYPKTSPPPTPVQRRLEVPVSGLRSSNKPVSKVSTLIKSFDRTESQRCESRPTASKPPALKNPPKFAPLPENSVNFCFDSAFLTVRRVPAEVSNTHQNSYQPGRKHGEQESSKNPEMACHGSSSFLPAANDTATLCESKFPSPHHKPVTGEPGRGKGTFLHSENSAFESWNAHQPKLLERKDTAGTVPESKAPKHYGDTTLLREPCPPERTVSPCQVQASCSQEENRLAAGALSTSIPWGCRDPGAQVFAVEGKAPSSQPDSQEKPAQPPWRKPKTGKKGKESLQDTLEEKTQTNQRGPPLYTKHNPQEQFSENNALDLPVEPNEHYDPPFNISKLLTPIIPSKHALDSADSQPAERTPSPPGQLNGYQEKEPSECQSRDSYKSKAPSLLFNLKDVRKRVKSTYSSSPLLKVLDEKTRGKVDGKQEPVSNGVILPNGLEESPPNELSKERPADDPTASHINPQKDPTADPSEPSADSYLTLSTAPTIAKAPFYVNGEAAERSSYENKEVEGELEMGPAGSSWCPDSREHRPRKHLSLRLCNRDPEPGGATEKMKTHQLENGLSRSVSQETEPEREAGLQNTHTHTHTHTHTHDHQHILSLFRSIKSRRQ

SEQ ID NO: 4183 - protein, 445 aa, Homo sapiens
MSELTKELMELVWGTKSSPGLSDTIFCRWTQGFVFSESEGSALEQFEGGPCAVIAPVQAFLLKKLLFSSEKSSWRDCSEEEQKELLCHTLCDILESACCDHSGSYCLVSWLRGKTTEETASISGSPAESSCQVEHSSALAVEELGFERFHALIQKRSFRSLPELKDAVLDQYSMWGNKFGVLLFLYSVLLTKGIENIKNEIEDASEPLIDPVYGHGSQSLINLLLTGHAVSNVWDGDRECSGMKLLGIHEQAAVGFLTLMEALRYCKVGSYLKSPKFPIWIVGSETHLTVFFAKDMALVAPEAPSEQARRVFQTYDPEDNGFIPDSLLEDVMKALDLVSDPEYINLMKNKLDPEGLGIILLGPFLQEFFPDQGSSGPESFTVYHYNGLKQSNYNEKVMYVEGTAVVMGFEDPMLQTDDTPIKRCLQTKWPYIELLWTTDRSPSLN

SEQ ID NO: 4184 - protein, 205 aa, Homo sapiens
MVNLAAMVWRRLLRKRWVLALVFGLSLVYFLSSTFKQEERAVRDRNLLQVHDHNQPIPWKVQFNLGNSSRPSNQCRNSIQGKHLITDELGYVCERKDLLVNGCCNVNVPSTKQYCCDGCWPNGCCSAYEYCVSCCLQPNKQLLLERFLNRAAVAFQNLFMAVEDHFELCLAKCRTSSQSVQHENTYRDPIAKYCYGESPPELFPA

SEQ ID NO: 4185 - protein, 426 aa, Homo sapiens
MQLGRSGRRSQKQKHEVDEVYFTLTRVDRSCPYLTVPGPPGAESGAPVRLGLRQRAVSSSRNPNSAGRTPNSYLTQAPVWRRSAPAQPPAPQTRHFPGRGADPALGSLPAAGLSGLCARTTGGTAQPPGARDSGASPGAQPQRHRPGVSDLRLTEKRPYHRCPTPRAKGARRRRRKRRRAVHCLRWDSRLPETLPKPSPAAAPPAGGTAGVRGAAAERWGERKGPRRLVLVHTSEKTPPPTRPNWPRRQPSRGSCALSSRQYGERPPAPPWTQPSVPRRGAATWGQEKAEYATPLGTQEARRASGGRGGVDHGDQGLSPCCGDGGARGRRRLPTFWPSGLLRLRLDSLGALPPEPSRAGRGRLFGLSVVLLKRNAGGEATPREGGPRRRWLRESCSPLPARHSRRRASWVSRWMEGAPPRMPSLPL

SEQ ID NO: 4186 - protein, 426 aa, Homo sapiens
MQLGRSGRRSQKQKHEVDEVYFTLTRVDRSCPYLTVPGPPGAESGAPVRLGLRQRAVSSSRNPNSAGRTPNSYLTQAPVWRRSAPAQPPAPQTRHFPGRGADPALGSLPAAGLSRLCARTTGGTAQPPGARDSGASPGAQPQRHRPGVSDLRLTEKRPYHRCPTPRAKGARRRRRKRRRAVHCLRWDSRLPETLPKPSPAAAPPAGGTAGVRGAAAERWGERKGPRRLVLVHTSEKTPPPTRPNWPRRQPSRGSCALSSRQYGERPPAPPWTQPSVPRRGAATWGQEKAEYATPLGTQEARRASGGRGGVDHGDQGLSPCCGDGGARGRRRLPTFWPSGLLRLRLDSLGALPPEPSRAGRGRLFGLSVVLLKRNAGGEATPREGGPRRRWLRESCSPLPARHSRRRASWVSRWMEGAPPRMPSLPL

SEQ ID NO: 4187 - protein, 115 aa, Homo sapiens
MSGEPGQTSVAPPPEEVEPGSGVRIVVEYCEPCGFEATYLELASAVKEQYPGIEIESRLGGTGAFEIEINGQLVFSKLENGGFPYEKDLIEAIRRASNGETLEKITNSRPPCVIL

SEQ ID NO: 4188 - protein, 562 aa, Homo sapiens
MLACLPGPGDLSFQPLSHTQMNTGLQKWDTTQKMRTAHYPTPAELDAYAKKVANNPLTIKIFPNSVKVPQRKHVRRTVNGLDTSAQRYSPYPTQAATKAGLLAIVKVPAKSILKDFDGTRARLLPEAIMNPPVAPYATVAPSTLAHPQAQALARQQALQHAQTLAHAPPQTLQHPQGIPPPQALSHPQSLQQPQGLGHPQPMAQTQGLVHPQALAHQGLQHPHNPLLHGGRKMPDSDAPPNVTVSTSTIPLSMAATLQHSRPPDLSSIVHQINQFCQTRAGISTTSVCEGQIANPSPISRSLLINASTRVSTHSVPTPMPSCVVNPMEHTHAATAALPAAGPVNLPTGISRVPTGYPSDLKPVTWNQHQLAHLQQMCSEASGTPAPGLTGKHAAGRELAGPGFVGKAPAYPQELCLAQSFHLKPPLEKPTPSPPVNGMAAPLAYPNGHYFQPLWNNILPTPNSDSSGSQDLAMPFHGGQPTGAPLDCAAAPGAHYRAGTGGGPVASQNSLMQTVDYLSGDFQQACFREQSLAMLSKAHRAPGNRAPDPTESRSLHILHPGYR

SEQ ID NO: 4189 - protein, 657 aa, Homo sapiens
MGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 4190 - protein, 245 aa, Homo sapiens
MDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVKVVTFCGHTSKTNQVNSGGVLLRLQVGEEVWLAVNDYYDMVGIQGSDSVFSGFLLFPD

SEQ ID NO: 4191 - protein, 177 aa, Homo sapiens
MATNYSANQYEKAFSSKYLQNWSPTKPTKESISSHEGYTQIIANDRGHLLPSVPRSKANPWGSFMGTWQMPLKIPPARVTLTSRTTAGAASLTKWIQKNPDLLKASNGLCPEILGKPHDPDSQKKLRKKSITKTVQQARSPTIIPSSPAANLNSPDELQSSHPSAGHTPGPQRPAKS

SEQ ID NO: 4192 - protein, 141 aa, Homo sapiens
MEPSHKDAETAAAAAAVAAADPRGASSSSGVVVQVREKKGPLRAAIPYMPFPVAVICLFLNTFVPGLGTFVSAFTVLCGARTDLPDRHVCCVFWLNIAAALIQILTAIVMVGWIMSIFWGMDMVILAISQGYKEQGIPQQL

SEQ ID NO: 4193 - protein, 585 aa, Homo sapiens
MLTLESFQSPGFAHVSGQKCLTSTEIMRIQRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSEPRCAWQSLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 4194 - protein, 941 aa, Homo sapiens
MNKKKKPFLGMPAPLGYVPGLGRGATGFTTRSDIGPARDANDPVDDRHAPPGKRTVGDQMKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRLSQVSDSVSGQTVVDPKGYLTDLNSMIPTHGGDINDIKKARLLLKSVRETNPHHPPAWIASARLEEVTGKLQVARNLIMKGTEMCPKSEDVWLEAARLQPGDTAKAVVAQAVRHLPQSVRIYIRAAELETDIRAKKRVLRKALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQANPNSEEIWLAAVKLESENDEYERARRLLAKARSSAPTARVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGLWLESVRLEYRAGLKNIANTLMAKALQECPNSGILWSEAIFLEARPQRRTKSVDALKKCEHDPHVLLAVAKLFWSQRKITKAREWFHRTVKIDSDLGDAWAFFYKFELQHGTEEQQEEVRKRCESAEPRHGELWCAVSKDIANWQKKIGDILRLVAGRIKNTF

SEQ ID NO: 4195 - protein, 129 aa, Homo sapiens
MSGGRRKEEPPQPQLANGALKVSVWSKVLRSDAAWEDKDEFLDVIYWFRQIIAVVLGVIWGVLPLRGFLGIAGFCLINAGVLYLYFSNYLQIDEEEYGGTWELTKEGFMTSFALFMVIWIIFYTAIHYD

SEQ ID NO: 4196 - protein, 143 aa, Homo sapiens
MSGGRRKEEPPQPQLANGALKVSVWSKVLRSDAAWEDKDEFLDVIYWFRQIIAVVLGVIWGVLPLRGFLGIAGSFGSSFTLPSIMTDGVQLPSAPYPVQRTLLITAQELDRWGTPAPWNLEDPCFLDRESVCWASVFSARVVT

SEQ ID NO: 4197 - protein, 87 aa, Homo sapiens
MSGGRRKEEPPQPQLANGALKVSVWSKVLRSDAAWEDKDEFLDVIYWFRQIIAVVLGVIWGVLPLRGFLGIAGKGHCCSGAVCVCDD

SEQ ID NO: 4198 - protein, 87 aa, Homo sapiens; identical to SEQ ID NO: 4197

SEQ ID NO: 4199 - protein, 296 aa, Homo sapiens
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFESQVPKYSAKWIDGSAGGISNCTQRILEQRENTDFGLSMLQDSGATLCRNSVLWPHSHNQAQKKEETISSPEANVQTQHPHYSREELNSMTLGEVEQLNAKLLQQIQVFEELTHQVQEKDSLASQLHVRHVAIEQLLKNCSKLPCLQVGRTGMKSHLPINN

SEQ ID NO: 4200 - protein, 372 aa, Homo sapiens
MTKGDFIDEEVEDMYLVDFTQKIIDKRKEMEASGAHRDSQKAGERDDDEENLPEGEIPPPQDPSEEWVDYVDSLGRSRRCMRKDLPDLLEMDKNLQGRLFISPANEKTLLSEDMRKELQRQQWEEEEREALKRPMGPVHYEDIRENEARQLGVGYFAFARDKELRNKQMKTLEMLREQTTDQRTKRENIKEKRKAILEARLAKLRQKKMKKSKEGGTEEENRDGDVIGPLPPEPEAVPTPRPAAQSSKVEVIVQERKDTKPGVPHIREWDRGKEFSFGYWSKRQSDLRAERDPEFAPPSDYFVGQKRTGFSSSQAWSRPGPAQSDPGQCPDQSHGPSPEHTSPTPAPDNPPQAPTVTFKTLDDMISYYKQVT

SEQ ID NO: 4201 - protein, 163 aa, Homo sapiens
MMCTAKKCGIRFQPPAIILIYESEIKGKIRQRIMPVRNFSKFSDCTRAAEQLKNNPRHKSYLEQVSLRQLEKLFSFLRGYLSGQSLAETMEQIQRETTIDPEEDLNKLDDKELAKRKSIMDELFEKNQKKKDDPNFVYDIEVEFPQDDQLQSCGWDTESADEF

SEQ ID NO: 4202 - protein, 354 aa, Homo sapiens
MCGRTSCHLPRDVLTRACAYQDRRGQQRLPEWRDPDKYCPSYNKSPQSNSPVLLSRLHFEKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGTAGLLEQWLKREKEEEPVAKRPYSQ

SEQ ID NO: 4203 - protein, 354 aa, Homo sapiens; identical to SEQ ID NO: 4202

SEQ ID NO: 4204 - protein, 130 aa, Homo sapiens
MRPGSSPRAPECGAPALPRPQLDRLPARPAPSRGRGAPSLRWPAKEVGPRPQIPATCEPGKVCGASAGRRDASRPSRPRSSRVTFSTRRQPGPQRGRWGLRGGPESVRGLPHLGLRISGTPLGIFSSWSL

SEQ ID NO: 4205 - protein, 1243 aa, Homo sapiens
MENCSAASTFLTDSLELELGTEWCKPPYFSCAVDNRGGGKHFSGESYLCSGALKRLILNLDPLPTNFEEDTLEIFGIQWVTETALVNSSRELFHLFRQQLYNLETLLQSSCDFGKVSTLHCKADNIRQQCVLFLHYVKVFIFRYLKVQNAESHVPVHPYEALEAQLPSVLIDELHGLLLYIGHLSELPSVNIGAFVNQNQIKLFPPSWHLLHLHLDIHWLVLEILYMLGEKLKQVVYGHQFMNLASDNLTNISLFEEHCETLLCDLISLSLNRYDKVRSSESLMSDQCPCLRIKELWVLLIHLLDHRSKWFVSESFWNWLNKLLKTLLEKSSDRRRSSMPVIQSRDPLGFSWWIITHVASFYKFDRHGVPDEMRKVESNWNFVEELLKKSISVQGVILEEQLRMYLHCCLTLCDFWEPNIAIVTILWEYYSKNLNSSFSISWLPFKGLANTMKSPLSMLEMVKTCCCDKQDQELYKSSSSYTIFLCILAKVVKKAMKSNGPHPWKQVKGRIYSKFHQKRMEELTEVGLQNFFSLFLLLAAVAEVEDVASHVLDLLNFLKPAFVMSQRALIWKGHMAFLLMYAQKNLDIGVLAEKFSCAFREKAKEFLVSKNEEMVQRQTIWTLLSIYIDGVQEVFETSYCLYPSHEKLLNDGFSMLLRACRESELRTVLSFLQAVLARIRSMHQQLCQELQRDNVDLFVQSSLSAKERHLAAVASALWRHFFSFLKSQRMSQVVPFSQLADAAADFTLLAMDMPSTAPSDFQPQPVISIIQLFGWDDIICPQVVARYLSHVLQNSTLCEALSHSGYVSFQALTVRSWIRCVLQMYIKNLSGPDDLLIDKNLEEAVEKEYMKQLVKLTRLLFNLSEVKSIFSKAQAEYLSISEDPKKALVRFFEAVGVTYGNVQTLSDKSAMVTKSLEYLGEVLKYIKPYLGKKVFSAGLQLTYGMMGILVKSWAQIFATSKAQKLLFRIIDCLLLPHAVLQQEKELPAPMLSAIQKSLPLYLQGMCIVCCQSQNPNAYLNQLLGNVIEQYIGRFLPASPYVSDLGQHPVLLALRNTATIPPISSLKKCIVQVIRKSYLEYKGSSPPPRLASILAFILQLFKETNTDIYEVELLLPGILKCLVLVSEPQVKRLATENLQYMVKACQVGSEEEPSSQLTSVFRQFIQDYGMRYYYQVYSILETVATLDQQVVIHLISTLTQSLKDSEQKWGLGRNIAQREAYSKLLSHLGQMGQDEMQRLENDNT

SEQ ID NO: 4206 - protein, 394 aa, Homo sapiens
MPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQTVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKVGFSNKVELGQQHFLSI

SEQ ID NO: 4207 - protein, 260 aa, Homo sapiens
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 4208 - protein, 598 aa, Homo sapiens
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASAKQKQKSTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQGPYLASGDQPLERATGEHASMHEYPGELGQPPGLYPSSHPPGRAGTLRALSRQDTFDADTPGSRNSAYTELGDSCVDMETDPSEGPGLGDPAGGGTPPARQGSWEDEEEDYEEELTDNRNRGRNKARYCAEGGGPVLGRNKNELEGWGRGVYIR

SEQ ID NO: 4209 - protein, 666 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKAPRVPDILSSVRRGSGAPEAEGPLPCPSPAPFSPLPAPSPRISDILNSVRRGSGTPEAEGPLSAGPPPCLSPALLGPLSSPSPRISDILNSVRRGSGTPEAEGPSPVGPPPCPSPTIPGPLPTPSRKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 4210 - protein, 542 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 4211 - protein, 518 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 4212 - protein, 517 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 4213 - protein, 503 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKPQTNSTKNSAAATSPKGTLPPAALESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 4214 - protein, 492 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKEPQTTVIHNPVDGIKESSDSANTTIEDEDAKARKQEIIKTTEQLIEAVNNGDFEAYAFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 4215 - protein, 479 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 4216 - protein, 449 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 4217 - protein, 592 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 4218 - protein, 592 aa, Homo sapiens; identical to SEQ ID NO: 4217

SEQ ID NO: 4219 - protein, 323 aa, Homo sapiens
MYHNSSQKRHWTFSSEEQLARLRADANRKFRCKAVANGKVLPNDPVFLEPHEEMTLCKYYEKRLLEFCSVFKPAMPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEEEWTDDDLVESL

SEQ ID NO: 4220 - protein, 325 aa, Homo sapiens
MDQYCILGRIGEGAHGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSVGCIMGELLNGSPLFPGKNDIEQLCYVLRILGTPNPQVWPELTELPDYNKISFKEQVPMPLEEVLPDVSPQALDLLGQFLLYPPHQRIAASKALLHQYFFTAPLPAHPSELPIPQRLGGPAPKAHPGPPHIHDFHVDRPLEESLLNPELIRPFILEG

SEQ ID NO: 4221 - protein, 338 aa, Homo sapiens
MDQYCILGRIGEGAHGIVFKAKHVEPRVGWQCLPSILQTGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSVGCIMGELLNGSPLFPGKNDIEQLCYVLRILGTPNPQVWPELTELPDYNKISFKEQVPMPLEEVLPDVSPQALDLLGQFLLYPPHQRIAASKALLHQYFFTAPLPAHPSELPIPQRLGGPAPKAHPGPPHIHDFHVDRPLEESLLNPELIRPFILEG

SEQ ID NO: 4222 - protein, 271 aa, Homo sapiens
MSAPRLLISIIIMVSASSSSCMGGKQMTQNYSTIFAEGNISQPVLMDINAVLCCPPIALRNLIIITWEIILRGQPSCTKAYKKETNETKETNCTVERITWVSRPDQNSDLQILPVDTTHDGYYRGIVVTPDGNFHRGYHLQVLVTPEVNLFQSRNITAVCKAVTGKPAAQISWIPEGSILATKQEYWGNGTVTVKSTCPWEGHKSTVTCHVSHLTGNKSLSVKLNSGLRTSGSPALSLLIILYVKLSLFVVILVTTGFVFFQRINHVRKVL

SEQ ID NO: 4223 - protein, 146 aa, Homo sapiens [sequence omitted]

SEQ ID NO: 4224 - protein, 619 aa, Homo sapiens
MNLERLRKRVRQYLDQQQYQSALFWADKVASLSREPQDIYWLAQCLYLTAQYHRAAHALRSRKLDKLYEACRYLAARCHYAAKEHQQALDVLDMEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 4225 - protein, 236 aa, Homo sapiens
MARPLVPSSQKALLLELKGLQEEPVEGFRVTLVDEGDLYNWEVAIFGPPNTYYEGGYFKARLKFPIDYPYSPPAFRFLTKMWHPNIYETGDVCISILHPPVDDPQSGELPSERWNPTQNVRTILLSVISLLNEPNTFSPANVDASVMYRKWKESKGKDREYTDIIRKQVLGTKVDAERDGVKVPTTLAEYCVKTKAPAPDEGSDLFYDDYYEDGEVEEEADSCFGDDEDDSGTEES

SEQ ID NO: 4226 - protein, 574 aa, Homo sapiens
MEASLGIQMDEPMAFSPQRDRFQAEGSLKKNEQNFKLAGVKKDIEKLYEAVPQLSNVFKIEDKIGEGTFSSVYLATAQLQVGPEEKIALKHLIPTSHPIRIAAELQCLTVAGGQDNVMGVKYCFRKNDHVVIAMPYLEHESFLDILNSLSFQEVREYMLNLFKALKRIHQFGIVHRDVKPSNFLYNRRLKKYALVDFGLAQGTHDTKIELLKFVQSEAQQERCSQNKSHIITGNKIPLSGPVPKELDQQSTTKASVKRPYTNAQIQIKQGKDGKEGSVGLSVQRSVFGERNFNIHSSISHESPAVKLMKQSKTVDVLSRKLATKKKAISTKVMNSAVMRKTASSCPASLTCDCYATDKVCSICLSRRQQVAPRAGTPGFRAPEVLTKCPNQTTAIDMWSAGVIFLSLLSGRYPFYKASDDLTALAQIMTIRGSRETIQAAKTFGKSILCSKEVPAQDLRKLCERLRGMDSSTPKLTSDIQGHASHQPAISEKTDHKASCLVQTPPGQYSGNSFKKGDSNSCEHCFDEYNTNLEGWNEVPDEAYDLLDKLLDLNPASRITAEEALLHPFFKDMSL

SEQ ID NO: 4227 - protein, 200 aa, Homo sapiens
MEQTEVLKPRTLADLIRILHQLFAGDEVNVEEVQAIMEAYESDPTEWAMYAKFDQYRYTRNLVDQGNGKFNLMILCWGEGHGSSIHDHTNSHCFLKMLQGNLKETLFAWPDKKSNEMVKKSERVLRENQCAYINDSIGLHRVENISHTEPAVSLHLYSPPFDTCHAFDQRTGHKNKVTMTFHSKFGIRTPNATSGSLENN

SEQ ID NO: 4228 - protein, 620 aa, Homo sapiens
MALGEEKAEAEASEDTKAQSYGRGSCRERELDIPGPMSGEQPPRLEAEGGLISPVWGAEGIPAPTCWIGTDPGSPSRAHQPQASDANREPVAERSEPALSGLPPATMGSGDLLLSGESQVEKTKLSSSEEFPQTLSLPRTTTICSGHDADTEDDPSLADLPQALDLSQQPHSSGLSCLSQWKSVLSPGSAAQPSSCSISASSTGSSLQGHQERAEPRGGSLAKVSSSLEPVVPQEPSSVVGLGPRPQWSPQPVFSGGDASGLGRRRLSFQAEYWACVLPDSLPPSPDRHSPLWNPNKEYEDLLDYTYPLRPGPQLPKHLDSRVPADPVLQDSGVDLDSFSVSPASTLKSPTNVSPNCPPAEATALPFSGPREPSLKQWPSRVPQKQGGMGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQTFCCQLEELICWLYNVADVTDHGTAARSNLTSLKSSLQLYRQFKKDIDEHQSLTESVLQKGEILLQCLLENTPVLEDVLGRIAKQSGELESHADRLYDSILASLDMLAGCTLIPDKKPMAAMEHPCEGV

SEQ ID NO: 4229 - protein, 1912 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 4230 - protein, 1954 aa, Homo sapiens
MRGPVGTEEELPRLFAEEMENEDEMSEEEDGGLEAFDDFFPVEPVSLPKKKKPKKLKENKCKGKRKKKEGSNDELSENEEDLEEKSESEGSDYSPNKKKKKKLKDKKEKKAKRKKKDEDEDDNDDGCLKEPKSSGQLMAEWGLDDVDYLFSEEDYHTLTNYKAFSQFLRPLIAKKNPKIPMSKMMTVLGAKWREFSANNPFKGSSAAAAAAAVAAAVETVTISPPLAVSPPQVPQPVPIRKAKTKEGKGPGVRKKIKGSKDGKKKGKGKKTAGLKFRFGGISNKRKKGSSSEEDEREESDFDSASIHSASVRSECSAALGKKSKRRRKKKRIDDGDGYETDHQDYCEVCQQGGEIILCDTCPRAYHLVCLDPELEKAPEGKWSCPHCEKEGIQWEPKDDDDEEEEGGCEEEEDDHMEFCRVCKDGGELLCCDACPSSYHLHCLNPPLPEIPNGEWLCPRCTCPPLKGKVQRILHWRWTEPPAPFMVGLPGPDVEPSLPPPKPLEGIPEREFFVKWAGLSYWHCSWVKELQLELYHTVMYRNYQRKNDMDEPPPFDYGSGDEDGKSEKRKNKDPLYAKMEERFYRYGIKPEWMMIHRILNHSFDKKGDVHYLIKWKDLPYDQCTWEIDDIDIPYYDNLKQAYWGHRELMLGEDTRLPKRLLKKGKKLRDDKQEKPPDTPIVDPTVKFDKQPWYIDSTGGTLHPYQLEGLNWLRFSWAQGTDTILADEMGLGKTVQTIVFLYSLYKEGHSKGPYLVSAPLSTIINWEREFEMWAPDFYVVTYTGDKESRSVIRENEFSFEDNAIRSGKKVFRMKKEVQIKFHVLLTSYELITIDQAILGSIEWACLVVDEAHRLKNNQSKFFRVLNSYKIDYKLLLTGTPLQNNLEELFHLLNFLTPERFNNLEGFLEEFADISKEDQIKKLHDLLGPHMLRRLKADVFKNMPAKTELIVRVELSQMQKKYYKFILTRNFEALNSKGGGNQVSLLNIMMDLKKCCNHPYLFPVAAVEAPVLPNGSYDGSSLVKSSGKLMLLQKMLKKLRDEGHRVLIFSQMTKMLDLLEDFLEYEGYKYERIDGGITGGLRQEAIDRFNAPGAQQFCFLLSTRAGGLGINLATADTVIIYDSDWNPHNDIQAFSRAHRIGQNKKVMIYRFVTRASVEERITQVAKRKMMLTHLVVRPGLGSKSGSMTKQELDDILKFGTEELFKDDVEGMMSQGQRPVTPIPDVQSSKGGNLAASAKKKHGSTPPGDNKDVEDSSVIHYDDAAISKLLDRNQDATDDTELQNMNEYLSSFKVAQYVVREEDGVEEVEREIIKQEENVDPDYWEKLLRHHYEQQQEDLARNLGKGKRIRKQVNYNDASQEDQEWQDELSDNQSEYSIGSEDEDEDFEERPEGQSGRRQSRRQLKSDRDKPLPPLLARVGGNIEVLGFNARQRKAFLNAIMRWGMPPQDAFNSHWLVRDLRGKSEKEFRAYVSLFMRHLCEPGADGAETFADGVPREGLSRQHVLTRIGVMSLVRKKVQEFEHVNGKYSTPDLIPEGPEGKKSGEVISSDPNTPVPASPAHLLPAPLGLPDKMEAQLGYMDEKDPGAQKPRQPLEVQALPAALDRVESEDKHESPASKERAREERPEETEKAPPSPEQLPREEVLPEKEKILDKLELSLIHSRGDSSELRPDDTKAEEKEPIETQQNGDKEEDDEGKKEDKKGKFKFMFNIADGGFTELHTLWQNEERAAVSSGKIYDIWHRRHDYWLLAGIVTHGYARWQDIQNDPRYMILNEPFKSEVHKGNYLEMKNKFLARRFKLLEQALVIEEQLRRAAYLNMTQDPNHPAMALNARLAEVECLAESHQHLSKESLAGNKPANAVLHKVLNQLEELLSDMKADVTRLPSMLSRIPPVAARLQMSERSILSRLTNRAGDPTIQQGAFGSSQMYSNNFGPNFRGPGPGGIVNYNQMPLGPYVTDI

SEQ ID NO: 4231 - protein, 468 aa, Homo sapiens
MAARGSGPRALRLLLLVQLVAGRCGLAGAAGGAQRGLSEPSSIAKHEDSLLKDLFQDYERWVRPVEHLNDKIKIKFGLAISQLVDVDEKNQLMTTNVWLKQEWIDVKLRWNPDDYGGIKVIRVPSDSVWTPDIVLFDNADGRFEGTSTKTVIRYNGTVTWTPPANYKSSCTIDVTFFPFDLQNCSMKFGSWTYDGSQVDIILEDQDVDKRDFFDNGEWEIVSATGSKGNRTDSCCWYPYVTYSFVIKRLPLFYTLFLIIPCIGLSFLTVLVFYLPSNEGEKICLCTSVLVSLTVFLLVIEEIIPSSSKVIPLIGEYLVFTMIFVTLSIMVTVFAINIHHRSSSTHNAMAPLVRKIFLHTLPKLLCMRSHVDRYFTQKEETESGSGPKSSRNTLEAALDSIRYITRHIMKENDVREVVEDWKFIAQVLDRMFLWTFLFVSIVGSLGLFVPVIYKWANILIPVHIGNANK

SEQ ID NO: 4232 - protein, 390 aa, Homo sapiens
MWLPRFSSKTVTVLLLAQTTCLLLFIISRPGPSSPAGGEDRVHVLVLSSWRSGSSFLGQLFSQHPDVFYLMEPAWHVWTTLSQGSAATLHMAVRDLMRSIFLCDMDVFDAYMPQSRNLSAFFNWATSRALCSPPACSAFPRGTISKQDVCKTLCTRQPFSLAREACRSYSHVVLKEVRFFNLQVLYPLLSDPALNLRIVHLVRDPRAVLRSREAAGPILARDNGIVLGTNGKWVEADPHLRLIREVCRSHVRIAEAATLKPPPFLRGRYRLVRFEDLAREPLAEIRALYAFTGLTLTPQLEAWIHNITHGSGIGKPIEAFHTSSRNARNVSQAWRHALPFTKILRVQEVCAGALQLLGYRPVYSADQQRDLTLDLVLPRGPDHFSWASPD

SEQ ID NO: 4233 - protein, 411 aa, Homo sapiens
MGMRARVPKVAHSTRRPPAARMWLPRFSSKTVTVLLLAQTTCLLLFIISRPGPSSPAGGEDRVHVLVLSSWRSGSSFLGQLFSQHPDVFYLMEPAWHVWTTLSQGSAATLHMAVRDLMRSIFLCDMDVFDAYMPQSRNLSAFFNWATSRALCSPPACSAFPRGTISKQDVCKTLCTRQPFSLAREACRSYSHVVLKEVRFFNLQVLYPLLSDPALNLRIVHLVRDPRAVLRSREAAGPILARDNGIVLGTNGKWVEADPHLRLIREVCRSHVRIAEAATLKPPPFLRGRYRLVRFEDLAREPLAEIRALYAFTGLTLTPQLEAWIHNITHGSGIGKPIEAFHTSSRNARNVSQAWRHALPFTKILRVQEVCAGALQLLGYRPVYSADQQRDLTLDLVLPRGPDHFSWASPD

SEQ ID NO: 4234 - protein, 745 aa, Homo sapiens
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLVVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMELQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 4235 - protein, 286 aa, Homo sapiens
MNPASDGGTSESIFDLDYASWGIRSTLMVAGFVFYLGVFVVCHQLSSSLNATYRSLVAREKVFWDLAATRAVFGVQSTAAGLWALLGDPVLHADKARGQQNWCWFHITTATGFFCFENVAVHLSNLIFRTFDLFLVIHHLFAFLGFLGCLVNLQAGHYLAMTTLLLEMSTPFTCVSWMLLKAGWSESLFWKLNQWLMIHMFHCRMVLTYHMWWVCFWHWDGLVSSLYLPHLTLFLVGLALLTLIINPYWTHKKTQQLLNPVDWNFAQPEAKSRPEGNGQLLRKKRP

SEQ ID NO: 4236 - protein, 925 aa, Homo sapiens
MATSADSPSSPLGAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELRLAREQARVCELQSGNQQLEEQRVELVERLQAMLQAHWDEANQLLSTTLPPPNPPAPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGYKPGRKEEGFSGWKLDYGEWSGTDGRGDNVPRRNTDSRLGEIPRKEIPSQAVPRRLATAPKTEKPPARKKSGHPAPSSMRSRGGVWR

SEQ ID NO: 4237 - protein, 903 aa, Homo sapiens
MATSADSPSSPLGAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELRLAREQAQVCELQSGNQQLEEQRVELVERLQAMLQAHWDEANQLLSTTLPPPNPPAPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGTDGRGDNVPRRNTDSRLGEIPRKEIPSQAVPRRLATAPKTEKPPARKKSGHPAPSSMRSRGGVWR

SEQ ID NO: 4238 - protein, 657 aa, Homo sapiens
MAEGSGEVVAVSATGAANGLNNGAGGTSATTCNPLSRKLHKILETRLDNDKEMLEALKALSTFFVENSLRTRRNLRGDIERKSLAINEEFVSIFKEVKEELESISEDVQAMSNCCQDMTSRLQAAKEQTQDLIVKTTKLQSESQKLEIRAQVADAFLSKFQLTSDEMSLLRGTREGPITEDFFKALGRVKQIHNDVKVLLRTNQQTAGLEIMEQMALLQETAYERLYRWAQSECRTLTQESCDVSPVLTQAMEALQDRPVLYKYTLDEFGTARRSTVVRGFIDALTRGGPGGTPRPIEMHSHDPLRYVGDMLAWLHQATASEKEHLEALLKHVTTQGVEENIQEVVGHITEGVCRPLKVRIEQVIVAEPGAVLLYKISNLLKFYHHTISGIVGNSATALLTTIEEMHLLSKKIFFNSLSLHASKLMDKVELPPPDLGPSSALNQTLMLLREVLASHDSSVVPLDARQADFVQVLSCVLDPLLQMCTVSASNLGTADMATFMVNSLYMMKTTLALFEFTDRRLEMLQFQIEAHLDTLINEQASYVLTRVGLSYIYNTVQQHKPEQGSLANMPNLDSVTLKAAMVQFDRYLSAPDNLLIPQLNFLLSATVKEQIVKQSTELVCRAYGEVYAAVMNPINEYKDPENILHRSPQQVQTLLS

SEQ ID NO: 4239 - protein, 308 aa, Homo sapiens
MAPPAPGPASGGSGEVDELFDVKNAFYIGSYQQCINEAQRVKLSSPERDVERDVFLYRAYLAQRKFGVVLDEIKPSSAPELQAVRMFADYLAHESRRDSIVAELDREMSRSVDVTNTTFLLMAASIYLHDQNPDAALRALHQGDSLECTAMTVQILLKLDRLDLARKELKRMQDLDEDATLTQLATAWVSLATGGEKLQDAYYIFQEMADKCSPTLLLLNGQAACHMAQGRWEAAEGLLQEALDKDSGYPETLVNLIVLSQHLGKPPEVTNRYLSQLKDAHRSHPFIKEYQAKENDFDRLVLQYAPSA

SEQ ID NO: 4240 - protein, 257 aa, Homo sapiens
MAPPAPGPASGGSGEVDELFDVKNAFYIGSYQQCINEAQRVKLSSPERDVERDVFLYRAYLAQRKFGVVLDEIKPSSAPELQAVRMFADYLAHESRSTAMTVQILLKLDRLDLARKELKRMQDLDEDATLTQLATAWVSLATGGEKLQDAYYIFQEMADKCSPTLLLLNGQAACHMAQGRWEAAEGLLQEALDKDSGYPETLVNLIVLSQHLGKPPEVTNRYLSQLKDAHRSHPFIKEYQAKENDFDRLVLQYAPSA

SEQ ID NO: 4241 - protein, 256 aa, Homo sapiens
MAPPAPGPASGGSGEVDELFDVKNAFYIGSYQQCINEAQRVKLSSPERDVERDVFLYRAYLAQRKFGVVLDEIKPSSAPELQAVRMFADYLAHESRRDSIVAELDREMSRSVDVTNTTFLLMAASIYLHDQNPDAALRALHQGDSLECTAMTVQILLKLDRLDLARKELKRMQDLDEDATLTQLATAWVSLATDSGYPETLVNLIVLSQHLGKPPEVTNRYLSQLKDAHRSHPFIKEYQAKENDFDRLVLQYAPSA

SEQ ID NO: 4242 - protein, 443 aa, Homo sapiens
MAASPHTLSSRLLTGCVGGSVWYLERRTIQDSPHKFLHLLRNVNKQWITFQHFSFLKRMYVTQLNRSHNQQVRPKPEPVASPFLEKTSSGQAKAEIYEMRPLSPPSLSLSRKPNEKELIELEPDSVIEDSIDVGKETKEEKRWKEMKLQVYDLPGILARLSKIKLTALVVSTTAAGFALAPGPFDWPCFLLTSVGTGLASCAANSINQFFEVPFDSNMNRTKNRPLVRGQISPLLAVSFATCCAVPGVAILTLGVNPLTGALGLFNIFLYTCCYTPLKRISIANTWVGAVVGAIPPVMGWTAATGSLDAGAFLLGGILYSWQFPHFNALSWGLREDYSRGGYCMMSVTHPGLCRRVALRHCLALLVLSAAAPVLDITTWTFPIMALPINAYISYLGFRFYVDADRRSSRRLFFCSLWHLPLLLLLMLTCKRPSGGGDAGPPPS

SEQ ID NO: 4243 - protein, 210 aa, Homo sapiens
MPGVKLTTQAYCKMVLHGAKYPHCAVNGLLVAEKQKPRKEHLPLGGPGAHHTLFVDCIPLFHGTLALAPMLEVALTLIDSWCKDHSYVIAGYYQANERVKDASPNQVAEKVASRIAEGFSDTALIMVDNTKFTMDCVAPTIHVYEHHENRWRCRDPHHDYCEDWPEAQRISASLLDSRSYETLVDFDNHLDDIRNDWTNPEINKAVLHLC

SEQ ID NO: 4244 - protein, 454 aa, Homo sapiens
MALQLGRLSSGPCWLVARGGCGGPRAWSQCGGGGLRAWSQRSAAGRVCRPPGPAGTEQSRGLGHGSTSRGGPWVGTGLAAALAGLVGLATAAFGHVQRAEMLPKTSGTRATSLGRPEEEEDELAHRCSSFMAPPVTDLGELRRRPGDMKTKMELLILETQAQVCQALAQVDGGANFSVDRWERKEGGGGISCVLQDGCVFEKAGVSISVVHGNLSEEAAKQMRSRGKVLKTKDGKLPFCAMGVSSVIHPKNPHAPTIHFNYRYFEVEEADGNKQWWFGGGCDLTPTYLNQEDAVHFHRTLKEACDQHGPDLYPKFKKWCDDYFFIAHRGERRGIGGIFFDDLDSPSKEEVFRFVQSCARAVVPSYIPLVKKHCDDSFTPQEKLWQQLRRGRYVEFNLLYDRGTKFGLFTPGSRIESILMSLPLTARWEYMHSPSENSKEAEILEVLRHPRDWVR

SEQ ID NO: 4245 - protein, 1454 aa, Homo sapiens
MAPVQLENHQLVPPGGGGGGSGGPPSAPAPPPPGAAVAAAAAAAASPGYRLSTLIEFLLHRAYSELMVLTDLLPRKSDVERKIEIVQFASRTRQLFVRLLALVKWANNAGKVEKCAMISSFLDQQAILFVDTADRLASLARDALVHARLPSFAIPYAIDVLTTGSYPRLPTCIRDKIIPPDPITKIEKQATLHQLNQILRHRLVTTDLPPQLANLTVANGRVKFRVEGEFEATLTVMGDDPDVPWRLLKLEILVEDKETGDGRALVHSMQISFIHQLVQSRLFADEKPLQDMYNCLHSFCLSLQLEVLHSQTLMLIRERWGDLVQVERYHAGKCLSLSVWNQQVLGRKTGTASVHKVTIKIDENDVSKPLQIFHDPPLPASDSKLVERAMKIDHLSIEKLLIDSVHARAHQKLQELKAILRGFNANENSSIETALPALVVPILEPCGNSECLHIFVDLHSGMFQLMLYGLDQATLDDMEKSVNDDMKRIIPWIQQLKFWLGQQRCKQSIKHLPTISSETLQLSNYSTHPIGNLSKNKLFIKLTRLPQYYIVVEMLEVPNKPTQLSYKYYFMSVNAADREDSPAMALLLQQFKENIQDLVFRTKTGKQTRTNAKRKLSDDPCPVESKKTKRAGEMCAFNKVLAHFVAMCDTNMPFVGLRLELSNLEIPHQGVQVEGDGFSHAIRLLKIPPCKGITEETQKALDRSLLDCTFRLQGRNNRTWVAELVFANCPLNGTSTREQGPSRHVYLTYENLLSEPVGGRKVVEMFLNDWNSIARLYECVLEFARSLPDIPAHLNIFSEVRVYNYRKLILCYGTTKGSSISIQWNSIHQKFHISLGTVGPNSGCSNCHNTILHQLQEMFNKTPNVVQLLQVLFDTQAPLNAINKLPTVPMLGLTQRTNTAYQCFSILPQSSTHIRLAFRNMYCIDIYCRSRGVVAIRDGAYSLFDNSKLVEGFYPAPGLKTFLNMFVDSNQDARRRSVNEDDNPPSPIGGDMMDSLISQLQPPPQQQPFPKQPGTSGAYPLTSPPTSYHSTVNQSPSMMHTQSPGNLHAASSPSGALRAPSPASFVPTPPPSSHGISIGPGASFASPHGTLDPSSPYTMVSPSGRAGNWPGSPQVSGPSPAARMPGMSPANPSLHSPVPDASHSPRAGTSSQTMPTNMPPPRKLPQRSWAASIPTILTHSALNILLLPSPTPGLVPGLAGSYLCSPLERFLGSVIMRRHLQRIIQQETLQLINSNEPGVIMFKTDALKCRVALSPKTNQTLQLKVTPENAGQWKPDELQVLEKFFETRVAGPPFKANTLIAFTKLLGAPTHILRDCVHIMKLELFPDQATQLKWNVQFCLTIPPSAPPIAPPGTPAVVLKSKMLFFLQLTQKTSVPPQEPVSIIVPIIYDMASGTTQQADIPRQQNSSVAAPMMVSNILKRFAEMNPPRQGECTIFAAVRDLMANLTLPPGGRP

SEQ ID NO: 4246 - protein, 192 aa, Homo sapiens
MAPKPGAEWSTALSHLVLGVVSLHAAVSTAEASRGAAAGFLLQVLAATTTLAPGLSTHEDCLAGAWVATVIGLPLLAFDFHWVNGDRSSANLLLGGGMVLAVAGGHLGPEGRSVAGQAMLLVVAVTILIVAVFTANTYGMWGGAMLGVAGLLSRLEEDRLLLLPKEDVCRWALAVGSWAYCRALHTQRLQWE

SEQ ID NO: 4247 - protein, 493 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 4248 - protein, 502 aa, Homo sapiens
MLAAMGSLAAALWAVVHPRTLLLGTVAFLLAADFLKRRRPKNYPPGPWRLPFLGNFFLVDFEQSHLEVQLFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKLSLKFRMGITISPVSHRLCAVPQV

SEQ ID NO: 4249 - protein, 543 aa, Homo sapiens
MATRRLGVGETLGALNAALGPGGPVWIKETRTRHLRSRDFLAPHRALQARFDDGQVPEHLLHALACLQGPGVAPVLRCAPTPAGLSLQLQRSAVFERVLSAVAAYATPASPASLGQRVLLHCPALRSSPCALRLSQLRTVLVADHLARALRAHGVCVRLVPAVRDPHMLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWQKLVDKAPLRQKHLICGPVKVAGAPGTLMTAPEYYEFRHTQVCKASALKHGGDLAQDPAWTEIFGVLSVATIKFEMLSTAPQSQLFLALADSSISTKGTKSGTFVMYNCARLATLFESYKCSMEQGLYPTFPPVSSLDFSLLHDEGEWLLLFNSILPFPDLLSRTAVLDCTAPGLHIAVRTEMICKFLVQLSMDFSSYYNRVHILGEPRPHLFGQMFVRLQLLRAVREVLHTGLAMLGLPPLSHI

SEQ ID NO: 4250 - protein, 376 aa, Homo sapiens
MLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWQKLVDKAPLRQKHLICGPVKVAGAPGTLMTAPEYYEFRHTQVCKASALKHGGDLAQDPAWTEIFGVLSVATIKFEMLSTAPQSQLFLALADSSISTKGTKSGTFVMYNCARLATLFESYKCSMEQGLYPTFPPVSSLDFSLLHDEGEWLLLFNSILPFPDLLSRTAVLDCTAPGLHIAVRTEMICKFLVQLSMDFSSYYNRVHILGEPRPHLFGQMFVRLQLLRAVREVLHTGLAMLGLPPLSHI

SEQ ID NO: 4251 - protein, 729 aa, Homo sapiens
MPTGFVAPILCVLLPSPTREAATVASATGDSASERESAAPAAAPTAEAPPPSVVTRPEPQALPSPAIRAPLPDLYPFGTMRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 4252 - protein, 938 aa, Homo sapiens
MNWNKGGPGTKRGFGFGGFAISAGKKEEPKLPQQSHSAFGATSSSSGFGKSAPPQLPSFYKIGSKRANFDEENAYFEDEEEDSSNVDLPYIPAENSPTRQQFHSKPVDSDSDDDPLEAFMAEVEDQAARDMKRLEEKDKERKNVKGIRDDIEEEDDQEAYFRYMAENPTAGVVQEEEEDNLEYDSDGNPIAPTKKIIDPLPPIDHSEIDYPPFEKNFYNEHEEITNLTPQQLIDLRHKLNLRVSGAAPPRPGSSFAHFGFDEQLMHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKKKATNLQRVSYLVFDEADRMFDMGFEYQVRSIASHVRPDRQTLLFSATFRKKIEKLARDILIDPIRVVQGDIGEANEDVTQIVEILHSGPSKWNWLTRRLVEFTSSGSVLLFVTKKANAEELANNLKQEGHNLGLLHGDMDQSERNKVISDFKKKDIPVLVATDVAARGLDIPSIKTVINYDVARDIDTHTHRIGRTGRAGEKGVAYTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSSRHSHGETGNRHSDSPRHGDGGRHGDGYRHPESSSRHTDGHRHGENRHGGSAGRHGENRGANDGRNGESRKEAFNRESKMEPKMEPKVDSSKMDKVDSKTDKTADGFAVPEPPKRKKSRWDS

SEQ ID NO: 4253 - protein, 938 aa, Homo sapiens; identical to SEQ ID NO: 4252

SEQ ID NO: 4254 - protein, 871 aa, Homo sapiens
MEVGFSRTTVQTLSRSHCKNIKQKISQWEGRANGISNPEKWCPKDFGVRYNCHQEIRLKKNPIAERKSKNLDVTSRENVGLDINENTKSHDQSENENKKHEYDDTHFFKNESESNWVCSRVKEIESCKEDVLDPETSLPPGNFYTSQILWKKIEALPPDKLLNLALEHCDSSEKELNFRVLDSSYGITKSLENIYSEPEGQECGPSINPLPKPRRTFRYLSESGVTPYKERNCDKKYCENNSCAQSSLASSQEPEPKKYGGKIRGRSKRKSFEFEDIQHFRNRNSQTIREELGRNSGSALYYTQSEDNIYEDIIYPTKENPYEDIPVQPLPMWRSPSAWKLPPAKSAFKAPKLVLKIDDIFESKRGKKKVKLHSYTGKELPPTKGETSGNESDAEYLPKNRHKRLAQLQPSSKRNPHYQTLERDLIELQEQQLFELFVVVSLQKKPSGISYIPQVIQQFPGKDDHGYKQSKDMEERLKVIPKFCFPDSKDWMPTSELKSETFSFVLTGEDGSRWFGYCKKLLPVGKGKRLPEVYCMVSRLGCFNLFSKILDEVEKRREMSPALVYPFMRSVMEAPFPAPGRTITVKSYLPGAGDESIELCRPLDSRLEHVDFKCLFKCLSVCHLIRVCASLLLERRVIFVANSLSTLSKCGHAVVATLYPFTWQHTYIPVLPASMIDIVCSPTPFLIGILSCSLPQLQDLPIEEVLIVDLCTDKFLQEVSDEDEILPPKLQAALMQILEERNEILTQEQNFSQDVTLNSLVSEAFVRFFVELVGHYSLNMTVTERGERVFQREPFRKSHTSRSVRHFLDLFMETQMFAGFIQDRELRKSGVKGLFEIRAIQYLETIPESEPSGMNRILRSLGSKMKFLQKK

SEQ ID NO: 4255 - protein, 1083 aa, Homo sapiens
MACPALGLEALQPLQPEPPPEPAFSEAQKWIEQVTGRSFGDKDFRTGLENGILLCELLNAIKPGLVKKINRLPTPIAGLDNIILFLRGCKELGLKESQLFDPSDLQDTSNRVTVKSLDYSRKLKNVLVTIYWLGKAANSCTSYSGTTLNLKEFEGLLAQMRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVTTPQFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKKSPREHFQAGPFSPCSPTPPGQSPNRSISGKKLCSSCGLPLGKGAAMIIETLNLYFHIQCFRCGICKGQLGDAVSGTDVRIRNGLLNCNDCYMRSRSAGQPTTL

SEQ ID NO: 4256 - protein, 398 aa, Homo sapiens
MGAKSMRSWCLCQICSCGSDYCPYEIVKQPRHVPEEYKPKQGKIDLGTTYKRDLNSYKVQPVAIVRPLERQVKKGKLDTVPTYKDDYRAWDLHKSELYKPEQTYHPPTVKFGNSTTFQDDFVPQEIKPRQSFKPSSVVKRSTAPFNGITSHRLDYIPHQLELKFERPKEVYKPTDQRFEDLTTHRCDFQGLIGETAKLCRPVHTRVTQNALFEGSTEFRESFQPWEIPPPEVKKVPEYVPPTGSMLLNSTSHLDYVPYQANHVVPIRPVSQKRSNNFPFQGKSIMKEDFPAWESCRQGLIKKQQQIPNPSGKFDGLSTFRSHYVPHELIPTESCKPLNIAFKSSVPFDDVTMYSVEYTPKRQEICPASYPSPPGYIFDNTNSQGHKFFRKIIPAVKAF

SEQ ID NO: 4257 - protein, 397 aa, Homo sapiens
MVKETQYYDILGVKPSASPEEIKKAYRKLALKCHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 4258 - protein, 223 aa, Homo sapiens
MATPQSIFIFAICILMITELILASKSYYDILGVPKSASERQIKKAFHKLAMKYHPDKNKSPDAEAKFREIAEAYETLSDANRRKEYDTLGHSAFTSGKGQRGSGSSFEQSFNFNFDDLFKDFGFFGQNQNTGSKKRFENHFQTRQDGGSSRQRHHFQEFSFGGGLFDDMFEDMEKMFSFSGFDSTNQHTVQTENRFHGSSKHCRTVTQRRGNMVTTYTDCSGQ

SEQ ID NO: 4259 - protein, 756 aa, Homo sapiens
MVVTRSARAKASIQAASAESSGQKSFAANGIQAHPESSTGSDARTTAESQTTGKQSLIPRTPKARKRKSRTTGSLPKGTEPSTDGETSEAESNYSVSEHHDTILRVTRRRQILIACSPVSSVRKKPKVTPTKESYTEEIVSEAESHVSGISRIVLPTEKTTGARRSKAKSLTDPSQESHTEAISDAETSSSDISFSGIATRRTRSMQRKLKAQTEKKDSKIVPGNEKQIVGTPVNSEDSDTRQTSHLQARSLSEINKPNFYNNDFDDDFSHRSSENILTVHEQANVESLKETKQNCKDLDEDANGITDEGKEINEKSSQLKNLSELQDTSLQQLVSQRHSTPQNKNAVSVHSNLNSEAVMKSLTQTFATVEVGRWNNNKKSPIKASDLTKFGDCGGSDDEEESTVISVSEDMNSEGNVDFECDTKLYTSAPNTSQGKDNSVLLVLSSDESQQSENSENEEDTLCFVENSGQRESLSGDTGSLSCDNALFVIDTTPGMSADKNFYLEEEDKASEVAIEEEKEEEEDEKSEEDSSDHDENEDEFSDEEDFLNSTKAKLLKLTSSSIDPGLSIKQLGGLYINFNADKLQSNKRTLTQIKEKKKNELLQKAVITPDFEKNHCVPPYSESKYQLQKKRRKERQKTAGDGWFGMKAPEMTNELKNDLKALKMRASMDPKRFYKKNDRDGFPKYFQIGTIVDNPADFYHSRIPKKQRKRTIVEELLADSEFRRYNRRKYSEIMAEKAANAAGKKFRKKKKFRN

SEQ ID NO: 4260 - protein, 514 aa, Homo sapiens
MDEGMEISSEGNSLIKAVHQSRLRLTRLLLEGGAYINESNDRGETPLMIACKTKHVDHQSVSKAKMVKYLLENNADPNIQDKSGKTALMHACLEKAGPEVVSLLLKSGADLSLQDHSSYSALVYAINSEDTETLKVLLSACKAKGKEVIIITTAKSPCGKHTTKQYLNMPPVDIDGCHSPATCTTPSEIDIKTASSPLSHSSETELTLFGFKDLELAGSNDDTWDPGSPVRKPALAPKGPKLPHAPPWVKSPPLLMHQNRVASLQEELQDITPEEELSYKTNGLALSKRFITRHQSIDVKDTAHLLRAFDQASSRKMSYDEINCQSYLSEGNQQCIEVPVDQDPDSNQTIFASTLRSIVQKRNLGANHYSSDSQLSAGLTPPTSEDGKALIGKKKILSPSPSQLSESKELLENIPPGPLSRRNHAVLEGRGSGAFPLDHSVTQTRQGFLPPLNVNSHPPISDINVNNKICSLLSCGQKVLMPTVPIFPKEFKSKKMLLRRQSLQTEQIKQLVNF

SEQ ID NO: 4261 - protein, 446 aa, Homo sapiens
MRTLNTSAMDGTGLVVERDFSVRILTACFLSLLILSTLLGNTLVCAAVIRFRHLRSKVTNFFVISLAVSDLLVAVLVMPWKAVAEIAGFWPFGSFCNIWVAFDIMCSTASILNLCVISVDRYWAISSPFRYERKMTPKAAFILISVAWTLSVLISFIPVQLSWHKAKPTSPSDGNATSLAETIDNCDSSLSRTYAISSSVISFYIPVAIMIVTYTRIYRIAQKQIRRIAALERAAVHAKNCQTTTGNGKPVECSQPESSFKMSFKRETKVLKTLSVIMGVFVCCWLPFFILNCILPFCGSGETQPFCIDSNTFDVFVWFGWANSSLNPIIYAFNADFRKAFSTLLGCYRLCPATNNAIETVSINNNGAAMFSSHHEPRGSISKECNLVYLIPHAVGSSEDLKKEEAAGIARPLEKLSPALSVILDYDTDVSLEKIQPITQNGQHPT

SEQ ID NO: 4262 - protein, 954 aa, Homo sapiens
MVMQGCPYTLPRCHDWQAADQFHHSSSLRSTCPHPQVRAAVTSPAPPQDGAGVPCLSLKLLNGSVGASGPLEPPAMNLCWNEIKKKSHNLRARLEAFSDHSGKLQLPLQEIIDWLSQKDEELSAQLPLQGDVALVQQEKETHAAFMEEVKSRAPYIYSVLESAQAFLSQHPFEELEEPHSESKDTSPKQRIQNLSRFVWKQATVASELWEKLTARCVDQHRHIERTLEQLLEIQGAMEELSTTLSQAEGVRATWEPIGDLFIDSLPEHIQAIKLFKEEFSPMKDGVKLVNDLAHQLAISDVHLSMENSQALEQINVRWKQLQASVDERLKQLQDAHRDFGPGSQHFLSSSVQVPWERAISPNKVPYYINHQAQTTCWDHPKMTELYQTLADLNNIKFSAYRTAMKLRRVQKALRLDLVTLTTALEIFNEHDLQASEHVMDVVEVIHCLTALYERLEEERGILVNVPLCVDMSLNWLLNVFDSGRSGKMRALSFKTGIACLCGTEVKEKLQYLFSQVANSGSQCDQRHLGVLLHEAIQVPRQLGEVAAFGGSNVEPSVRSCFRFSTGKPVIEASQFLEWVNLEPQSMVWLPVLHRVTIAEQVKHQTKCSICRQCPIKGFRYRSLKQFNVDICQTCFLTGRASKGNKLHYPIMEYYTPTTSSENMRDFATTLKNKFRSKHYFSKHPQRGYLPVQSVLEADYSETPASSPMWPHADTHSRIEHFASRLAEMESQNCSFFNDSLSPDDSIDEDQYLLRHSSPITDREPAFGQQAPCSVATESKGELQKILAHLEDENRILQGELRRLKWQHEEAAEAPSLADGSTEAATDHRNEELLAEARILRQHKSRLETRMQILEDHNKQLESQLQRLRELLLQPPTESDGSGSAGSSLASSPQQSEGSHPREKGQTTPDTEAADDVGSKSQDVSLCLEDIMEKLRHAFPSVRSSDVTANTLLAS

SEQ ID NO: 4263 - protein, 627 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKEEEQKQAAQATGSPHTSPTHGGGRPMPMPVRSTSAGSTPTHCPQDSLSGVGGDVQEAFAQGTRRNLRNDLLVAADSITNTMSSLVKELHSAEEGAEEEEEKMQNGKDRG

SEQ ID NO: 4264 - protein, 597 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKEEEQKQAAQATGSPHTSPTHGGGRPMPMPVRSTSAGSTPTHCPQDSLSGVGGDVQEAFAQAEEGAEEEEEKMQNGKDRG

SEQ ID NO: 4265 - protein, 567 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKEEEQKQAAQATGSPHTSPTHGGGRPMPMPVRSTSAGSTPTHCPQDSLSGVGGDVQEAFAQAEEGAEEEEEKMQNGKDRG

SEQ ID NO: 4266 - protein, 609 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKEEEQKQAAQATGSPHTSPTHGGGRPMPMPVRSTSAGSTPTHCPQDSLSGVGGDVQEAFAQGTRRNLRNDLLVAADSITNTMSSLVKELHSG

SEQ ID NO: 4267 - protein, 560 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKAQATGSPHTSPTHGGGRPMPMPVRSTSAGSTPTHCPQDSLSGVGGDVQEAFAQAEEGAEEEEEKMQNGKDRG

SEQ ID NO: 4268 - protein, 211 aa, Homo sapiens
MCPGNWLWASMTFMARFSRSSSRSPVRTRGTLEEMPTVQHPFLNVFELERLLYTGKTACNHADEVWPGLYLGDQDMANNRRELRRLGITHVLNASHSRWRGTPEAYEGLGIRYLGVEAHDSPAFDMSIHFQTAADFIHRALSQPGGKILVHCAVGVSRSATLVLAYLMLYHHLTLVEAIKKVKDHRGIIPNRGFLRQLLALDRRLRQGLEA

SEQ ID NO: 4269 - protein, 1208 aa, Homo sapiens
MDSLPDEFFVRHPAVEDQRKEETENKLEKSSGQLNKQENDIPTDLVPVNLLLEVKKLLNAINTLPKGVVPHIKKFLQEDFSFQTMQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKDEMPIFKLDYNYFYHLLHIIIISGTDIVRQIFDEAMPPPLLKKELLIHKNVLESYYNHLWTNHPLGGSWHLLYPPNKELPQSKQFDLCLLLALIKHLNVFPAPKKGWNMEPPSSDISKSADILRLCKYRDILLSEILMNGLTESQFNSIWKKVSDILLRLGMMQEDIDKVKENPIENISLDYHQLSVYLGIPVPEIIQRMLSCYQQGIALQSITGSQRIEIEELQNEEEELSPPLMEYNINVKSHPEIQFAEINKDGTSIPSESSTESLKDLQEVKSKQRKKKKTKNKKNKDSKEDQVPYVVEKEEQLRKEQANPHSVSRLIKDDASDVQEDSAMEDKFYSLDELHILDMIEQGSAGKVTTDYGETEKERLARQRQLYKLHYQCEDFKRQLRTVTFRWQENQMQIKKKDKIIASLNQQVAFGINKVSKLQRQIHAKDNEIKNLKEQLSMKRSQWEMEKHNLESTMKTYVSKLNAETSRALTAEVYFLQCRRDFGLLHLEQTEKECLNQLARVTHMAASNLESLQLKAAVDSWNAIVADVRNKIAFLRTQYNEQINKVKQGFALSTLPPVQLPPPPPSPEILMQQFLGRPLVKESFFRPILTVPQMPAVCPGVVSATGQPRAPLMTGIAWALPAPVGDAVPPSAGLRSDPSIMNWERITDRLKTAFPQQTRKELTDFLRKLKDAYGKSLSELTFDEIVCKISQFIDPKKSQSQGKSVSNVNCVSPSHSPSQPDAAQPPKPAWRPLTSQGPATWEGASNPDEEEEEEEPCVICHENLSPENLSVLPCAHKFHAQCIRPWLMQQGTCPTCRLHVLLPEEFPGHPSRQLPKI

SEQ ID NO: 4270 - protein, 775 aa, Homo sapiens
MEPPYSLTAHYDEFQEVKYVSRCGAGGARGASLPPGFPLGAARSATGARSGLPRWNRREVCLLSGLVFAAGLCAILAAMLALKYLGPVAAGGGACPEGCPERKAFARAARFLAANLDASIDPCQDFYSFACGGWLRRHAIPDDKLTYGTIAAIGEQNEERLRRLLARPGGGPGGAAQRKVRAFFRSCLDMREIERLGPRPMLEVIEDCGGWDLGGAEERPGVAARWDLNRLLYKAQGVYSAAALFSLTVSLDDRNSSRYVIRIDQDGLTLPERTLYLAQDEDSEKVLAAYRVFMERVLSLLGADAVEQKAQEILQVEQQLANITVSEYDDLRRDVSSMYNKVTLGQLQKITPHLRWKWLLDQIFQEDFSEEEEVVLLATDYMQQVSQLIRSTPHRVLHNYLVWRVVVVLSEHLSPPFREALHELAQEMEGSDKPQELARVCLGQANRHFGMALGALFVHEHFSAASKAKVQQLVEDIKYILGQRLEELDWMDAETRAAARAKLQYMMVMVGYPDFLLKPDAVDKEYEFEVHEKTYFKNILNSIRFSIQLSVKKIRQEVDKSTWLLPPQALNAYYLPNKNQMVFPAGILQPTLYDPDFPQSLNYGGIGTIIGHELTHGYDDWGGQYDRSGNLLHWWTEASYSRFLRKAECIVRLYDNFTVYNQRVNGKHTLGENIADMGGLKLAYHAYQKWVREHGPEHPLPRLKYTHDQLFFIAFAQNWCIKRRSQSIYLQVLTDKHAPEHYRVLGSVSQFEEFGRVLHCPKVSPMNPAHKCSVW

SEQ ID NO: 4271 - protein, 382 aa, Homo sapiens
MGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSEKSLALLKTVIIVLSVFIACWAPLFILLLLDVGCKVKTCDILFRAEYFLVLAVLNSGTNPIIYTLTNKEMRRAFIRIMSCCKCPSGDSAGKFKRPIIAGMEFSRSKSDNSSHPQKDEGDNPETIMSSGNVNSSS

SEQ ID NO: 4272 - protein, 630 aa, Homo sapiens
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 4273 - protein, 120 aa, Homo sapiens
MSSSAGSGHQPSQSRAIPTRTVAISDAAQLPHDYCTTPGGTLFSTTPGGTRIIYDRKFLLDRRNSPMAQTPPCHLPNIPGVTSPGTLIEDSKVEVNNLNNLNNHDRKHAVGDDAQFEMDI

SEQ ID NO: 4274 - protein, 826 aa, Homo sapiens
MWALCSLLRSAAGRTMSQGRTISQAPARRERPRKDPLRHLRTREKRGPSGCSGGPNTVYLQVVAAGSRDSGAALYVFSEFNRYLFNCGEGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSELNENEPHLPHGVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 4275 - protein, 834 aa, Homo sapiens
MEDGFSSYSSLYDTSSLLQFCNDDSASAASSMEVTDRIASLEQRVQMQEDDIQLLKSALADVVRRLNITEEQQAVLNRKGPTKARPLMQTLPLRTTVNNGTVLPKKPTGSLPSPSGVRKETAVPATKRLNRSVSLLNACKLNRSTPSNIKRTSSSERVSPGGRRESNGDSRGNRNRTGSTSSSSSGKKNSESKPKEPVFSAEEGYVKMFLRGRPVTMYMPKDQVDSYSLEAKVELPTKRLKLEWVYGYRGRDCRNNLYLLPTGETVYFIASVVVLYNVEEQLQRHYAGHNDDVKCLAVHPDRITIATGQVAGTSKDGKQLPPHVRIWDSVTLNTLHVIGIGFFDRAVTCIAFSKSNGGTNLCAVDDSNDHVLSVWDWQKEEKLADVKCSNEAVFAADFHPTDTNIIVTCGKSHLYFWTLEGSSLNKKQGLFEKQEKPKFVLCVTFSENGDTITGDSSGNILVWGKGTNRISYAVQGAHEGGIFALCMLRDGTLVSGGGKDRKLISWSGNYQKLRKTEIPEQFGPIRTVAEGKGDVILIGTTRNFVLQGTLSGDFTPITQGHTDELWGLAIHASKSQFLTCGHDKHATLWDAVGHRPVWDKIIEDPAQSSGFHPSGSVVAVGTLTGRWFVFDTETKDLVTVHTDGNEQLSVMRYSPDGNFLAIGSHDNCIYIYGVSDNGRKYTRVGKCSGHSSFITHLDWSVNSQFLVSNSGDYEILYWVPSACKQVVSVETTRDIEWATYTCTLGFHVFGVWPEGSDGTDINAVCRAHEKKLLSTGDDFGKVHLFSYPCSQFRAPSHIYGGHSSHVTNVDFLCEDSHLISTGGKDTSIMQWRVI

SEQ ID NO: 4276 - protein, 815 aa, Homo sapiens
MEDGFSSYSSLYDTSSLLQFCNDDSASAASSMEVTDRIASLEQRVQMQEDDIQLLKSALADVVRRLNITEEQQAVLNRKGPTKARPLMQTLPLRTTVNNGTVLPKKPTGSLPSPSGVRKETAVPATKSNIKRTSSSERVSPGGRRESNGDSRGNRNRTGSTSSSSSGKKNSESKPKEPVFSAEEGYVKMFLRGRPVTMYMPKDQVDSYSLEAKVELPTKRLKLEWVYGYRGRDCRNNLYLLPTGETVYFIASVVVLYNVEEQLQRHYAGHNDDVKCLAVHPDRITIATGQVAGTSKDGKQLPPHVRIWDSVTLNTLHVIGIGFFDRAVTCIAFSKSNGGTNLCAVDDSNDHVLSVWDWQKEEKLADVKCSNEAVFAADFHPTDTNIIVTCGKSHLYFWTLEGSSLNKKQGLFEKQEKPKFVLCVTFSENGDTITGDSSGNILVWGKGTNRISYAVQGAHEGGIFALCMLRDGTLVSGGGKDRKLISWSGNYQKLRKTEIPEQFGPIRTVAEGKGDVILIGTTRNFVLQGTLSGDFTPITQGHTDELWGLAIHASKSQFLTCGHDKHATLWDAVGHRPVWDKIIEDPAQSSGFHPSGSVVAVGTLTGRWFVFDTETKDLVTVHTDGNEQLSVMRYSPDGNFLAIGSHDNCIYIYGVSDNGRKYTRVGKCSGHSSFITHLDWSVNSQFLVSNSGDYEILYWVPSACKQVVSVETTRDIEWATYTCTLGFHVFGVWPEGSDGTDINAVCRAHEKKLLSTGDDFGKVHLFSYPCSQFRAPSHIYGGHSSHVTNVDFLCEDSHLISTGGKDTSIMQWRVI

SEQ ID NO: 4277 - protein, 105 aa, Homo sapiens
MSQKQEEENPAEETGEEKQDTQEKEGILPERAEEAKLKAKYPSLGQKPGGSDFLMKRLQKGVWGIVSYPLSLELKEVLRMKSVEVLLDPFLEVLLLNRSRGEFEI

SEQ ID NO: 4278 - protein, 1308 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 4279 - protein, 840 aa, Homo sapiens
MMSIQEKSKENSSKVTKKSDDKNSETEIQDSQKNLAKKSGPKETIKSQAKSSSESKINQPELETRMSTRSSKAASNDKATKSINKNTVTVRGYSQESTKKKLSQKKLVHENPKANEQLNRRSQRLQQLTEVSRRSLRSREIQGQVQAVKQSLPPTKKEQCSSTQSKSNKTSQKHVKRKVLEVKSDSKEDENLVINEVINSPKGKKRKVEHQTACACSSQCTQGSEKCPQKTTRRDETKPVPVTSEVKRSKMATSVVPKKNEMKKSVHTQVNTNTTLPKSPQPSVPEQSDNELEQAGKSKRGSILQLCEEIAGEIESDNVEVKKESSQMESVKEEKPTEIKLEETSVERQILHQKETNQDVQCNRFFPSRKTKPVKCILNGINSLAKKNSNWTKIKLSKFNSVQHNKLDSQVSPKLGLLRTSFSPPALEMHHPVTQSTFLGTKLHDRNITCQQEKMKEINSEEVKINDITVEINKTTERAPENCHLANEIKPSDPPLDNQMKHSFDSASNKNFSQCLESKLENSPVENVTAASTLLSQAKIDTGENKFPGSAPQQHSILSNQTSKSSDNRETPRNHSLPKCNSHLEITIPKDLKLKEAEKTDEKQLIIDAGQKRFGAVSCNVCGMLYTASNPEDETQHLLFHNQFISAVKYVGWKKERILAEYPDGRIIMVLPEDPKYALKKVDEIREMVDNDLGFQQAPLMCYSRTKTLLFISNDKKVVGCLIAEHIQWGYRVIEEKLPVIRSEEEKVRFERQKAWCCSTLPEPAICGISRIWVFSMMRRKKIASRMIECLRSNFIYGSYLSKEEIAFSDPTPDGKLFATQYCGTGQFLVYNFINGQNST

SEQ ID NO: 4280 - protein, 894 aa, Homo sapiens
MTAIKHALQRDIFTPNDERLLSIVNVCKAGKKKKNCFLCATVTTERPVQVKVVKVKKSDKGDFYKRQIAWALRDLAVVDAKDAIKENPEFDLHFEKIYKWVASSTAEKNAFISCIWKLNQRYLRKKIDFVNVSSQLLEESVPSGENQSVTGGDEEVVDEYQELNAREEQDIEIMMEGCEYAISNAEAFAEKLSRELQVLDGANIQSIMASEKQVNILMKLLDEALKEVDQIELKLSSYEEMLQSVKEQMDQISESNHLIHLSNTNNVKLLSEIEFLVNHMDLAKGHIKALQEGDLASSRGIEACTNAADALLQCMNVALRPGHDLLLAVKQQQQRFSDLRELFARRLASHLNNVFVQQGHDQSSTLAQHSVELTLPNHHPFHRDLLRYAKLMEWLKSTDYGKYEGLTKNYMDYLSRLYEREIKDFFEVAKIKMTGTTKESKKFATLPRKESAVKQETESLHGSSGKLTGSTSSLNKLSVQSSGNRRSQSSSLLDMGNMSASDLDVADRTKFDKIFEQVLSELEPLCLAEQDFISKFFKLQQHQSMPGTMAEAEDLDGGTLSRQHNCGTPLPVSSEKDMIRQMMIKIFRCIEPELNNLIALGDKIDSFNSLYMLVKMSHHVWTAQNVDPASFLSTTLGNVLVTVKRNFDKCISNQIRQMEEVKISKKSKVGILPFVAEFEEFAGLAESIFKNAERRGDLDKAYTKLIRGVFVNVEKVANESQKTPRDVVMMENFHHIFATLSRLKISCLEAEKKEAKQKYTDHLQSYVIYSLGQPLEKLNHFFEGVEARVAQGIREEEVSYQLAFNKQELRKVIKEYPGKEVKKGLDNLYKKVDKHLCEEENLLQVVWHSMQDEFIRQYKHFEGLIARCYPGSGVTMEFTIQDILDYCSSIAQSH

SEQ ID NO: 4281 - protein, 894 aa, Homo sapiens; identical to SEQ ID NO: 4280

SEQ ID NO: 4282 - protein, 879 aa, Homo sapiens
MTAIKHALQRDIFTPNDERLLSIVNVCKAGKKKKNCFLCATVTTERPVQVKVVKVKKSDKGDFYKRQIAWALRDLAVVDAKDAIKENPEFDLHFEKIYKWVASSTAEKNAFISCIWKLNQRYLRKKIDFVNVSSQLLEESVPSGENQSVTGGDEEVVDEYQELNAREEQDIEIMMEGCEYAISNAEAFAEKLSRELQVLDGANIQSIMASEKQVNILMKLLDEALKEVDQIELKLSSYEEMLQSVKEQMDQISESNHLIHLSNTNNVKLLSEIEFLVNHMDLAKGHIKALQEGDLASSRGIEACTNAADALLQCMNVALRPGHDLLLAVKQQQQRFSDLRELFARRLASHLNNVFVQQGHDQSSTLAQHSVELTLPNHHPFHRDLLRYAKLMEWLKSTDYGKYEGLTKNYMDYLSRLYEREIKDFFEVAKIKMTGTTKESKKFGLHGSSGKLTGSTSSLNKLSVQSSGNRRSQSSSLLDMGNMSASDLDVADRTKFDKIFEQVLSELEPLCLAEQDFISKFFKLQQHQSMPGTMAEAEDLDGGTLSRQHNCGTPLPVSSEKDMIRQMMIKIFRCIEPELNNLIALGDKIDSFNSLYMLVKMSHHVWTAQNVDPASFLSTTLGNVLVTVKRNFDKCISNQIRQMEEVKISKKSKVGILPFVAEFEEFAGLAESIFKNAERRGDLDKAYTKLIRGVFVNVEKVANESQKTPRDVVMMENFHHIFATLSRLKISCLEAEKKEAKQKYTDHLQSYVIYSLGQPLEKLNHFFEGVEARVAQGIREEEVSYQLAFNKQELRKVIKEYPGKEVKKGLDNLYKKVDKHLCEEENLLQVVWHSMQDEFIRQYKHFEGLIARCYPGSGVTMEFTIQDILDYCSSIAQSH

SEQ ID NO: 4283 - protein, 135 aa, Homo sapiens
MATVQQLEGRWRLVDSKGFDEYMKELGVGIALRKMGAMAKPDCIITCDGKNLTIKTESTLKTTQFSCTLGEKFEETTADGRKTQTVCNFTDGALVQHQEWDGKESTITRKLKDGKLVVECVMNNVTCTRIYEKVE

SEQ ID NO: 4284 - protein, 3051 aa, Homo sapiens
MATNPQPQPPPPAPPPPPPQPQPQPPPPPPGPGAGPGAGGAGGAGAGAGDPQLVAMIVNHLKSQGLFDQFRRDCLADVDTKPAYQNLRQRVDNFVANHLATHTWSPHLNKNQLRNNIRQQVLKSGMLESGIDRIISQVVDPKINHTFRPQVEKAVHEFLATLNHKEEGSGNTAPDDEKPDTSLITQGVPTPGPSANVANDAMSILETITSLNQEASAARASTETSNAKTSERASKKLPSQPTTDTSTDKERTSEDMADKEKSTADSGGEGLETAPKSEEFSDLPCPVEEIKNYTKEHNNLILLNKDVQQESSEQKNKSTDKGEKKPDSNEKGERKKEKKEKTEKKFDHSKKSEDTQKVKDEKQAKEKEVESLKLPSEKNSNKAKTVEGTKEDFSLIDSDVDGLTDITVSSVHTSDLSSFEEDTEEEVVTSDSMEEGEITSDDEEKNKQNKTKTQTSDSSEGKTKSVRHAYVHKPYLYSKYYSDSDDELTVEQRRQSIAKEKEERLLRRQINREKLEEKRKQKAEKTKSSKTKGQGRSSVDLEESSTKSLEPKAARIKEVLKERKVLEKKVALSKKRKKDSRNVEENSKKKQQYEEDSKETLKTSEHCEKEKISSSKELKHVHAKSEPSKPARRLSESLHVVDENKNESKLEREHKRRTSTPVIMEGVQEETDTRDVKRQVERSEICTEEPQKQKSTLKNEKHLKKDDSETPHLKSLLKKEVKSSKEKPEREKTPSEDKLSVKHKYKGDCMHKTGDETELHSSEKGLKVEENIQKQSQQTKLSSDDKTERKSKHRNERKLSVLGKDGKPVSEYIIKTDENVRKENNKKERRLSAEKTKAEHKSRRSSDSKIQKDSLGSKQHGITLQRRSESYSEDKCDMDSTNMDSNLKPEEVVHKEKRRTKSLLEEKLVLKSKSKTQGKQVKVVETELQEGATKQATTPKPDKEKNTEENDSEKQRKSKVEDKPFEETGVEPVLETASSSAHSTQKDSSHRAKLPLAKEKYKSDKDSTSTRLERKLSDGHKSRSLKHSSKDIKKKDENKSDDKDGKEVDSSHEKARGNSSLMEKKLSRRLCENRRGSLSQEMAKGEEKLAANTLSTPSGSSLQRPKKSGDMTLIPEQEPMEIDSEPGVENVFEVSKTQDNRNNNSQQDIDSENMKQKTSATVQKDELRTCTADSKATAPAYKPGRGTGVNSNSEKHADHRSTLTKKMHIQSAVSKMNPGEKEPIHRGTTEVNIDSETVHRMLLSAPSENDRVQKNLKNTAAEEHVAQGDATLEHSTNLDSSPSLSSVTVVPLRESYDPDVIPLFDKRTVLEGSTASTSPADHSALPNQSLTVRESEVLKTSDSKEGGEGFTVDTPAKASITSKRHIPEAHQATLLDGKQGKVIMPLGSKLTGVIVENENITKEGGLVDMAKKENDLNAEPNLKQTIKATVENGKKDGIAVDHVVGLNTEKYAETVKLKHKRSPGKVKDISIDVERRNENSEVDTSAGSGSAPSVLHQRNGQTEDVATGPRRAEKTSVATSTEGKDKDVTLSPVKAGPATTTSSETRQSEVALPCTSIEADEGLIIGTHSRNNPLHVGAEASECTVFAAAEEGGAVVTEGFAESETFLTSTKEGESGECAVAESEDRAADLLAVHAVKIEANVNSVVTEEKDDAVTSAGSEEKCDGSLSRDSEIVEGTITFISEVESDGAVTSAGTEIRAGSISSEEVDGSQGNMMRMGPKKETEGTVTCTGAEGRSDNFVICSVTGAGPREERMVTGAGVVLGDNDAPPGTSASQEGDGSVNDGTEGESAVTSTGITEDGEGPASCTGSEDSSEGFAISSESEENGESAMDSTVAKEGTNVPLVAAGPCDDEGIVTSTGAKEEDEEGEDVVTSTGRGNEIGHASTCTGLGEESEGVLICESAEGDSQIGTVVEHVEAEAGAAIMNANENNVDSMSGTEKGSKDTDICSSAKGIVESSVTSAVSGKDEVTPVPGGCEGPMTSAASDQSDSQLEKVEDTTISTGLVGGSYDVLVSGEVPECEVAHTSPSEKEDEDIITSVENEECDGLMATTASGDITNQNSLAGGKNQGKVLIISTSTTNDYTPQVSAITDVEGGLSDALRTEENMEGTRVTTEEFEAPMPSAVSGDDSQLTASRSEEKDECAMISTSIGEEFELPISSATTIKCAESLQPVAAAVEERATGPVLISTADFEGPMPSAPPEAESPLASTSKEEKDECALISTSIAEECEASVSGVVVESENERAGTVMEEKDGSGIISTSSVEDCEGPVSSAVPQEEGDPSVTPAEEMGDTAMISTSTSEGCEAVMIGAVLQDEDRLTITRVEDLSDAAIISTSTAECMPISASIDRHEENQLTADNPEGNGDLSATEVSKHKVPMPSLIAENNCRCPGPVRGGKEPGPVLAVSTEEGHNGPSVHKPSAGQGHPSAVCAEKEEKHGKECPEIGPFAGRGQKESTLHLINAEEKNVLLNSLQKEDKSPETGTAGGSSTASYSAGRGLEGNANSPAHLRGPEQTSGQTAKDPSVSIRYLAAVNTGAIKADDMPPVQGTVAEHSFLPAEQQGSEDNLKTSTTKCITGQESKIAPSHTMIPPATYSVALLAPKCEQDLTIKNDYSGKWTDQASAEKTGDDNSTRKSFPEEGDIMVTVSSEENVCDIGNEESPLNVLGGLKLKANLKMEAYVPSEEEKNGEILAPPESLCGGKPSGIAELQREPLLVNESLNVENSGFRTNEEIHSESYNKGEISSGRKDNAEAISGHSVEADPKEVEEEERHMPKRKRKQHYLSSEDEPDDNPDVLDSRIETAQRQCPETEPHDTKEENSRDLEELPKTSSETNSTTSRVMEEKDEYSSSETTGEKPEQNDDDTIKSQEEDQPIIIKRKRGRPRKYPVETTLKMKDDSKTDTGIVTVEQSPSSSKLKVMQTDESNKETANLQERSISNDDGEEKIVTSVRRRGRKPKRSLTVSDDAESSEPERKRQKSVSDPVEDKKEQESDEEEEEEEEDEPSGATTRSTTRSEAQRSKTQLSPSIKRKREVSPPGARTRGQQRVEEAPVKKAKR

SEQ ID NO: 4285 - protein, 278 aa, Homo sapiens
MGARLSRRRLPADPSLALDALPPELLVQVLSHVPPRSLVTRCRPVCRAWRDIVDGPTVWLLQLARDRSAEGRALYAVAQRCLPSNEDKEEFPLCALARYCLRAPFGRNLIFNSCGEQGFRGWEVEHGGNGWAIEKNLTPVPGAPSQTCFVTSFEWCSKRQLVDLVMEGVWQELLDSAQIEICVADWWGARENCGCVYQLRVRLLDVYEKEVVKFSASPDPVLQWTERGCRQVSHVFTNFGKGIRYVSFEQYGRDVSSWVGHYGALVTHSSVRVRIRLS

SEQ ID NO: 4286 - protein, 287 aa, Homo sapiens
MKQGLWLLEMGARLSRRRLPADPSLALDALPPELLVQVLSHVPPRSLVTRCRPVCRAWRDIVDGPTVWLLQLARDRSAEGRALYAVAQRCLPSNEDKEEFPLCALARYCLRAPFGRNLIFNSCGEQGFRGWEVEHGGNGWAIEKNLTPVPGAPSQTCFVTSFEWCSKRQLVDLVMEGVWQELLDSAQIEICVADWWGARENCGCVYQLRVRLLDVYEKEVVKFSASPDPVLQWTERGCRQVSHVFTNFGKGIRYVSFEQYGRDVSSWVGHYGALVTHSSVRVRIRLS

SEQ ID NO: 4287 - protein, 148 aa, Homo sapiens
MAVASDFYLRYYVGHKGKFGHEFLEFEFRPDGKLRYANNSNYKNDVMIRKEAYVHKSVMEELKRIIDDSEITKEDDALWPPPDRVGRQELEIVIGDEHISFTTSKIGSLIDVNQSKDPEGLRVFYYLVQDLKCLVFSLIGLHFKIKPI

SEQ ID NO: 4288 - protein, 540 aa, Homo sapiens
MAAGGSAPEPRVLVCLGALLAGWVAVGLEAVVIGEVHENVTLHCGNISGLRGQVTWYRNNSEPVFLLSSNSSLRPAEPRFSLVDATSLHIESLSLGDEGIYTCQEILNVTQWFQVWLQVASGPYQIEVHIVATGTLPNGTLYAARGSQVDFSCNSSSRPPPVVEWWFQALNSSSESFGHNLTVNFFSLLLISPNLQGNYTCLALNQLSKRHRKVTTELLVYYPPPSAPQCWAQMASGSFMLQLTCRWDGGYPDPDFLWIEEPGGVIVGKSKLGVEMLSESQLSDGKKFKCVTSHIVGPESGASCMVQIRGPSLLSEPMKTCFTGGNVTLTCQVSGAYPPAKILWLRNLTQPEVIIQPSSRHLITQDGQNSTLTIHNCSQDLDEGYYICRADSPVGVREMEIWLSVKEPLNIGGIVGTIVSLLLLGLAIISGLLLHYSPVFCWKVGNTSRGQNMDDVMVLVDSEEEEEEEEEEEEDAAVGEQEGAREREELPKEIPKQDHIHRVTALVNGNIEQMGNGFQDLQDDSSEEQSDIVQEEDRPV

SEQ ID NO: 4289 - protein, 847 aa, Homo sapiens
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFAGEAHDPLVEALVTEAWRRLERFDIKLLSEFSSCLADQHLYFSPLMGKIADIVHRNLETTQDLSSLSVLMVNISSLISRHFQQQLMNKTELLFDTIDSSEANVAKSIAKFLRNVRYRYQPLLERCNNVFLSNVDHLDLDSISKILSVYKFLQFNSFEFIIMAKKKPTEMIPLCNHPASFVKLFVALGPIAGPEEKKQLKSTMLLMSEDLTGEQALAVLGAMGDMESRNSCLIKRVTSVLHKHLDGYKPLELLKITQELTFLHFQRKEFFAKLRELLLSYLKNSFIPTEVSVLVRAISLLPSPHLDEVGISRIEAVLPQCDLNNLSSFATSVLRWIQHDHVYLDNMTAKQLKLLQKLDHYGRQRLQHSNSLDLLRKELKSLKGNTFPESLLEEMIATLQHFMDDINYINVGEIASFISSTDYLSTLLLDRIASVAVQQIEKIHPFTIPAIIRPFSVLNYDPPQRDEFLGTCVQHLNSYLGILDPFILVFLGFSLATLEYFPEDLLKAIFNIKFLARLDSQLEILSPSRSARVQFHLMELNRSVCLECPEFQIPWFHDRFCQQYNKGIGGMDGTQQQIFKMLAEVLGGINCVKASVLTPYYHKVDFECILDKRKKPLPYGSHNIALGQLPEMPWESNIEIVGSRLPPGAERIALEFLDSKALCRNIPHMKGKSAMKKRHLEILGYRVIQISQFEWNSMALSTKDARMDYLRECIFGEVKSCL

SEQ ID NO: 4290 - protein, 582 aa, Homo sapiens
MDPKAGGGGEEDDCVDSGAETGGSDYSHLSSTSNGFSTWRMPCCLFLYCTHGDKEKGRWSLQVEHTWPSGELSVEEAQDPFLVSIHIIADPGESQPLQEAIDNVLAWIHPDLPLFRVSERRASRRRRKPPKGAQPALAVVLFLQEEYGEEQILQLHRTLQQPPWRHHHTEQVHGRFLPYLPCSQDFFTLAPGTPLWAIRPVHYGKEIVRFTVYCRYDNYADSLRFYQLILRRNPSQKKADFCIFPIFSNLDVDIQFSLKRLPCDQCPVPTDSSVLEFRVRDIGELVPLLPNPCSPISEGRWQTEDHDGNKILLQAQRVHKKFPKPGRVHHASEKKRHSTPLPSTAVPSHTPGSSQQSPLNSPHPGPIRTGLPPGHQQEFAGRANSTPNPPWSFQRSKSLFCLPTGGPSLASSAEPQWFSNTGAPGHRASEWRHGHLLSIDDLEGAQETDVDTGLRLSSSDLSVVSAYSAPSRFCSTVETPLPSERCSSHWAAHKDSREGPLPTVSRVTTEASWASLPFFTKRSSSSSATARAAPPAPSTSTLTDSSPQLPCDTPKVKQTDGDMPPPPGSAGPGDNDMEEFYI

SEQ ID NO: 4291 - protein, 602 aa, Homo sapiens
MDSLQDTVALDHGGCCPALSRLVPRGFGTEMWTLFALSGPLFLFQVLTFMIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQGWLKGQEEESPFQTPGLSILHPSHSHLSRASFHLFQKITWPQVLSGVVGNCVNGVANYALVSVLNLGVRGSAYANIISQFAQTVFLLLYIVLKKLHLETWAGWSSQCLQDWGPFFSLAVPSMLMICVEWWAYEIGSFLMGLLSVVDLSAQAVIYEVATVTYMIPLGLSIGVCVRVGMALGAADTVQAKRSAVSGVLSIVGISLVLGTLISILKNQLGHIFTNDEDVIALVSQVLPVYSVFHVFEAICCVYGGVLRGTGKQAFGAAVNAITYYIIGLPLGILLTFVVRMRIMGLWLGMLACVFLATAAFVAYTARLDWKLAAEEAKKHSGRQQQQRAESTATRPGPEKAVLSSVATGSSPGITLTTYSRSECHVDFFRTPEEAHALSAPTSRLSVKQLVIRRGAALGAASATLMVGLTVRILATRH

SEQ ID NO: 4292 - protein, 279 aa, Homo sapiens
MAALGRPFSGLPLSGGSDFLQPPQPAFPGRAFPPGADGAELAPRPGPRAVPSSPAGSAARGRVSVHCKKKHKREEEEDDDCPVRKKRITEAELCAGPNDWILCAHQDVEGHGVNPSVSGLSIPGILDVICEEMDQTTGEPQCEVARRKLQEIEDRIIDEDEEVEADRNVNHLPSLVLSDTMKTGLKREFDEVFTKKMIESMSRPSMELVLWKPLPELLSDKPKPSSNTKNYTGESQAKHVAAGTAFPQRTELFSEPRPTGMSLYNSLETATSTEEEMEL

SEQ ID NO: 4293 - protein, 608 aa, Homo sapiens
MALRGPAGLGPGSRRPLDEAVAGAEGREAPALVAAGGAPEDDEEDDGRGRGLLRWDSFSAWLHCVCVVGFDLELGQAVEVIYPQHSKLTDREKTNICYLSFPDSNSGCLGDTQFCFRFRQSSGRRVSLHCLLDQFDKDLPVYLKKDPAYFYGYVYFRQVRDKTLKRGYFQKSLVLISKLPYIHFFHTVLKQIAPEYFEKNEPYLEAACNDVDRWPAPVPGKTLHLPIMGVVMKVRIPTCHDKPGTTQIVQLTQQVDTNISVILPTVHEVDIFRCFCPVFLHSQMLWELVLLGEPLVVMAPSPSESSETVLALVNCISPLKYFSDFRPYFTIHDSEFKEYTTRTQAPPSVILGVTNPFFAKTLQHWPHIIRIGDLKPTGEIPKQVKVKKLKNLKTLDSKPGVYTSYKPYLNRDEEIIKQLQKGVQQKRPSEAQSVILRRYFLELTQSFIIPLERYVASLMPLQKSISPWKSPPQLRQFLPEEFMKTLEKTGPQLTSRIKGDWIGLYRHFLKSPNFDGWFKTRRKEMTQKLEALHLEALCEEDLLLWIQKHTEVETVDLVLKLKNKLLQADREHLPVKPDTMEKLRTHIDAIILALPEDLQGILLKTGMT

SEQ ID NO: 4294 - protein, 550 aa, Homo sapiens
MKWEEYEELLHYAIVTPNIEPRASQSSHPKGELVPDVRISTIHDILHSQGNNSEVRETAIEVGKGCDFHISSHSKTDESSPVLSPRKPSHPVMDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGIDSTNNKKEEYGPGVQGKEHSAHLDPSAPPMPLPVTSPLLPSPPAAVGGASATAVPSAASMTSTRAASASSVHVPVSALGAGSAATAASEEMYVPRVVTSAQQKAGRTITARITGRCDFASKNRISSSLAIMGVSPPMSSVVVEKHHPVTVQTIPQATAAKYPRTIHPESSTSASRSLGTRSAHTQSLTSVHSIKVVD

SEQ ID NO: 4295 - protein, 2676 aa, Homo sapiens
  VARIANT 1667, 2221, 2227: Xaa = Any Amino Acid
MNIGLRVFLVIADSLQQKDGEPPMPTTGVILPSGNTLRVKKIFLNKTLTDEEAKVIGMSVYYPQVRKALDSILRHLDKEVGRPMCMTSVQMSNKEPEDMITGERKPKIDLFRTCIAAIPRLIPDGMSRTDLIELLARLTIHMDEELRALAFNTLQALMLDFPDWREDVLSGFVYFIVREVTDVHPTLLDNAVKMLVQLINQWKQAAQMHNKNQDTQHGVANGASHPPPLERSPYSNVFHVVEGFALVILCSSRPATRRLAVSVLREIRALFALLEIPKGDDELAIDVMDRLSPSILESFIHLTGADQTTLLYCPSSIDLQTLAEWNSSPISHQFDVISPSHIWIFAHVTQGQDPWIISLSSFLKQENLPKHCSTAVSYAWMFAYTRLQLLSPQVDINSPINAKKVNTTTSSDSYIGLWRNYLILCCSAATSSSSTSAGSVRCSPPETLASTPDSGYSIDSKIIGIPSPSSLFKHIVPMMRSESMEITESLVLGLGRTNPGAFRELIEELHPIIKEALERRPENMKRRRRRDILRVQLVRIFELLADAVPFTSSFVFFNIFSASGGLDNETHFLNNTLLEYVDLTRQLLEAENEKDSDTLKDIRCHFSALVANIIQNVPVHQRRSIFPQQSLRHSLFMLFSHWAGPFSIMFTPLDRYSDRNMQINRHQYCALKAMSAVLCCGPVADNVGLSSDGYLYKWLDNILDSLDKKVHQLGCEAVTLLLELNPDQSNLMYWAVDRCYTGSGRVAAGCFKAIANVFQNRDYQCDTVMLLNLILFKAADSSRSIYEVAMQLLQILEPKMFRYAHKLEVQRTDGVLSQLSPLPHLYSVSYYQLSEELARAYPELTLAIFSEISQRIQTAHPAGRQVMLHYLLPWMNNIELVDLKPLPTARRHDEDEDDSLKDRELMVTSRRWLRGEGWGSPQATAMVLNNLMYMTAKYGDELAWSEVENVWTTLADGWPKNLKIILHFLISICGVNSEPSLLPYVKKVIVYLGRDKTMQLLEELVSELQLTDPVSSGVTHMDNPPYYRITSSYKIPSVTSGTTSSSNTMVAPTDGNPDNKPIKENIEESYVHLDIYSGLNSHLNRQHHRLESRYSSSSGGSYEEEKSDSMPLYSNWRLKVMEHNQGEPLPFPPAGGCWSPLVDYVPETSSPGLPLHRCNIAVILLTDLIIDHSVKVEWGSYLHLLLHAIFIGFDHCHPEVYEHCKRLLLHLLIVMGPNSNIRTVASVLLRNKEFNEPRVLTVKQVAHLDYNFTGINDFIPDYQPSPMTDSGLSSSSTSSSISLGNNSAAISHLHTTILNEVDISVEQDGKVKTLMEFITSRKRGPLWNHEDVSAKNPSIKSAEQLTTFLKHVVSVFKQSSSGIHLEHHLSEVALQTALSCSSRHYAGRSFQIFRALKQPLTATTLSDVLSRLVETVGDPGEDAQGFVIELLLTLESAIDTLAETMKHYDLLSALSQTSYHDPIMGNKYAANRKSTGQLNLSTSPINSSSYLGYNSNARSNSLRLSLIGDRRGDRRRSNTLDIMDGRINHSSSLARTRSLSSLREKGMYDVQSTTEPTNLMATIFWIAASLLESDYEYEYLLALRLLNKLLIHLPLDKSESREKIENVQSKLKWTNFPGLQQLFLKGFTSASTQEMTVHLLSKLISVSKHTLVDPSQLSGDIEYPRKXKENGFCEPSKKITLTFKIMCNKIGYCLLFFVLIGFPLNILCLLPHLIQHFDSPTQFCKETASRIAKVCAEEKCPTLVNLAHMMSLYSTHTYSRDCSNWINVVCRYLHDSFSDTTFNLVTYLAELLEKGLSSMQQSLLQIIYSLLSHIDLSAAPAKQFNLEIIKIIGKYVQSPYWKEALNILKLVVSRSASLVVPSDIPKTYGGDTGSPEISFTKIFNNVSKELPGKTLDFHFDISETPIIGNKYGDQHSAAGRNGKPKVIAVTRSTSSTSSGSNSNALVPVSWKRPQLSQRRTREKLMNVLSLCGPESGLPKNPSVVFSSNEDLEVGDQQTSLISTTEDINQEEEVAVEDNSSEQQFGVFKDFDFLDVELEDAEGESMDNFNWGVRRRSLDSIDKGDTPSLQEYQCSSSTPSLNLTNQEDTDESSEEEAALTASQILSRTQMLNSDSATDETIPDHPDLLLQSEDSTGSITTEEVLQIRDETPTLEASLDNANSRLPENVLLLSIKTEKAFKKISFQAGHCGLPECPFLLCNIHTLHSDLKRGLNSPQLPQLDXELSHHXQLIQPISLEPLPLEHVTTFEDEGSYIIQEQQESLVCQGILDLEETEMPEPLAPESYPESVCEEDVTLALKELDERCEEEEADFSGLSSQDEEEQDGFPEVQTSPLPSPFLSAIIAAFQPVAYDDEEEAWRCHVNQMLSDTDGSSAVFTFHVFSRLFQTIQRKFGEITNEAVSFLGDSLQRIGTKFKSSLEVMMLCSECPTVFVDAETLMSCGLLETLKFGVLELQEHLDTYNVKREAAEQWLDDCKRTFGAKEDMYRINTDAQELELCRRLYKLHFQLLLLFQAYCKLINQVNTIKNEAEVINMSEELAQLESILKEAESASENEEIDISKAAQTTIETAIHSLIETLKNKEFISAVAQVKAFRSLWPSDIFGSCEDDPVQTLLHIYFHHQTLGQTGSFAVIGSNLDMSEANYKLMELNLEIRESLRMVQSYQLLAQAKPMGNMVSTGF

SEQ ID NO: 4296 - protein, 2676 aa, Homo sapiens
  VARIANT 1667, 2221, 2227: Xaa = Any Amino Acid
MNIGLRVFLVIADSLQQKDGEPPMPTTGVILPSGNTLRVKKIFLNKTLTDEEAKVIGMSVYYPQVRKALDSILRHLDKEVGRPMCMTSVQMSNKEPEDMITGERKPKIDLFRTCIAAIPRLIPDGMSRTDLIELLARLTIHMDEELRALAFNTLQALMLDFPDWREDVLSGFVYFIVREVTDVHPTLLDNAVKMLVQLINQWKQAAQMHNKNQDTQHGVANGASHPPPLERSPYSNVFHVVEGFALVILCSSRPATRRLAVSVLREIRALFALLEIPKGDDELAIDVMDRLSPSILESFIHLTGADQTTLLYCPSSIDLQTLAEWNSSPISHQFDVISPSHIWIFAHVTQGQDPWIISLSSFLKQENLPKHCSTAVSYAWMFAYTRLQLLSPQVDINSPINAKKVNTTTSSDSYIGLWRNYLILCCSAATSSSSTSAGSVRCSPPETLASTPDSGYSIDSKIIGIPSPSSLFKHIVPMMRSESMEITESLVLGLGRTNPGAFRELIEELHPIIKEALERRPENMKRRRRRDILRVQLVRIFELLADAVPFTSSFVFFNIFSASGGLDNETHFLNNTLLEYVDLTRQLLEAENEKDSDTLKDIRCHFSALVANIIQNVPVHQRRSIFPQQSLRHSLFMLFSHWAGPFSIMFTPLDRYSDRNMQINRHQYCALKAMSAVLCCGPVADNVGLSSDGYLYKWLDNILDSLDKKVHQLGCEAVTLLLELNPDQSNLMYWAVDRCYTGSGRVAAGCFKAIANVFQNRDYQCDTVMLLNLILFKAADSSRSIYEVAMQLLQILEPKMFRYAHKLEVQRTDGVLSQLSPLPHLYSVSYYQLSEELARAYPELTLAIFSEISQRIQTAHPAGRQVMLHYLLPWMNNIELVDLKPLPTARRHDEDEDDSLKDRELMVTSRRWLRGEGWGSPQATAMVLNNLMYMTAKYGDELAWSEVENVWTTLADGWPKNLKIILHFLISICGVNSEPSLLPYVKKVIVYLGRDKTMQLLEELVSELQLTDPVSSGVTHMDNPPYYRITSSYKIPSVTSGTTSSSNTMVAPTDGNPDNKPIKENIEESYVHLDIYSGLNSHLNRQHHRLESRYSSSSGGSYEEEKSDSMPLYSNWRLKVMEHNQGEPLPFPPAGGCWSPLVDYVPETSSPGLPLHRCNIAVILLTDLIIDHSVKVEWGSYLHLLLHAIFIGFDHCHPEVYEHCKRLLLHLLIVMGPNSNIRTVASVLLRNKEFNEPRVLTVKQVAHLDYNFTGINDFIPDYQPSPMTDSGLSSSSTSSSISLGNNSAAISHLHTTILNEVDISVEQDGKVKTLMEFITSRKRGPLWNHEDVSAKNPSIKSAEQLTTFLKHVVSVFKQSSSGIHLEHHLSEVALQTALSCSSRHYAGRSFQIFRALKQPLTATTLSDVLSRLVETVGDPGEDAQGFVIELLLTLESAIDTLAETMKHYDLLSALSQTSYHDPIMGNKYAANRKSTGQLNLSTSPINSSSYLGYNSNARSNSLRLSLIGDRRGDRRRSNTLDIMDGRINHSSSLARTRSLSSLREKGMYDVQSTTEPTNLMATIFWIAASLLESDYEYEYLLALRLLNKLLIHLPLDKSESREKIENVQSKLKWTNFPGLQQLFLKGFTSASTQEMTVHLLSKLISVSKHTLVDPSQLSGDIEYPRKXKENGFCEPSKKITLTFKIMCNKIGYCLLFFVLIGFPLNILCLLPHLIQHFDSPTQFCKETASRIAKVCAEEKCPTLVNLAHMMSLYSTHTYSRDCSNWINVVCRYLHDSFSDTTFNLVTYLAELLEKGLSSMQQSLLQIIYSLLSHIDLSAAPAKQFNLEIIKIIGKYVQSPYWKEALNILKLVVSRSASLVVPSDIPKTYGGDTGSPEISFTKIFNNVSKELPGKTLDFHFDISETPIIGNKYGDQHSAAGRNGKPKVIAVTRSTSSTSSGSNSNALVPVSWKRPQLSQRRTREKLMNVLSLCGPESGLPKNPSVVFSSNEDLEVGDQQTSLISTTEDINQEEEVAVEDNSSEQQFGVFKDFDFLDVELEDAEGESMDNFNWGVRRRSLDSIDKGDTPSLQEYQCSSSTPSLNLTNQEDTDESSEEEAALTASQILSRTQMLNSDSATDETIPDHPDLLLQSEDSTGSITTEEVLQIRDETPTLEASLDNANSRLPENVLLLSIKTEKALKKISFQAGHCGLPECPFLLCNIHTLHSDLKRGLNSPQLPQLDXELSHHXQLIQPISLEPLPLEHVTTFEDEGSYIIQEQQESLVCQGILDLEETEMPEPLAPESYPESVCEEDVTLALKELDERCEEEEADFSGLSSQDEEEQDGFPEVQTSPLPSPFLSAIIAAFQPVAYDDEEEAWRCHVNQMLSDTDGSSAVFTFHVFSRLFQTIQRKFGEITNEAVSFLGDSLQRIGTKFKSSLEVMMLCSECPTVFVDAETLMSCGLLETLKFGVLELQEHLDTYNVKREAAEQWLDDCKRTFGAKEDMYRINTDAQELELCRRLYKLHFQLLLLFQAYCKLINQVNTIKNEAEVINMSEELAQLESILKEAESASENEEIDISKAAQTTIETAIHSLIETLKNKEFISAVAQVKAFRSLWPSDIFGSCEDDPVQTLLHIYFHHQTLGQTGSFAVIGSNLDMSEANYKLMELNLEIRESLRMVQSYQLLAQAKPMGNMVSTGF

SEQ ID NO: 4297 - protein, 493 aa, Homo sapiens
MTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKDSTGKYWTVGSDSAVTSSGDTPVDFFFEFCDYNKVAIKVGGRYLKGDHAGVLKASAETVDPASLWEY

SEQ ID NO: 4298 - protein, 537 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 4299 - protein, 585 aa, Homo sapiens
MARPDPSAPPSLLLLLLAQLVGRAAAASKAPVCQEITVPMCRGIGYNLTHMPNQFNHDTQDEAGLEVHQFWPLVEIQCSPDLRFFLCSMYTPICLPDYHKPLPPCRSVCERAKAGCSPLMRQYGFAWPERMSCDRLPVLGRDAEVLCMDYNRSEATTAPPRPFPAKPTLPGPPGAPASGGECPAGGPFVCKCREPFVPILKESHPLYNKVRTGQVPNCAVPCYQPSFSADERTFATFWIGLWSVLCFISTSTTVATFLIDMERFRYPERPIIFLSACYLCVSLGFLVRLVVGHASVACSREHNHIHYETTGPALCTIVFLLVYFFGMASSIWWVILSLTWFLAAGMKWGNEAIAGYAQYFHLAAWLIPSVKSITALALSSVDGDPVAGICYVGNQNLNSLRGFVLGPLVLYLLVGTLFLLAGFVSLFRIRSVIKQGGTKTDKLEKLMIRIGIFTLLYTVPASIVVACYLYEQHYRESWEAALTCACPGHDTGQPRAKPEYWVLMLKYFMCLVVGITSGVWIWSGKTVESWRRFTSRCCCRPRRGHKSGGAMAAGDYPEASAALTGRTGPPGPAATYHKQVSLSHV
